United States Patent 11,446,398 (REGULATED BIOCIRCUIT SYSTEMS) - sequence listing, part 52

SEQ ID NO: 144666 - DNA, 6401 bp, Homo sapiens
  Payload ID: 8582
  Gene Symbol: ITCH
  Gene Name: itchy E3 ubiquitin protein ligase
  Uniprot ID: Q96J02
  ENST ID: ENST00000374864
  CDS Start-End: 214-2802
gcgctcaggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttca

SEQ ID NO: 144667 - DNA, 6089 bp, Homo sapiens
  Payload ID: 8582
  Gene Symbol: ITCH
  Gene Name: itchy E3 ubiquitin protein ligase
  Uniprot ID: Q96J02
  ENST ID: ENST00000535650
  CDS Start-End: 233-2491
agtgtctcctttgccatgttcaggttttccaacctattggtggtatgtctgacagtggatcacaacttggttcaatgggtagcctcaccatgaaatcacagcttcagatcactgtatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttc

SEQ ID NO: 144668 - DNA, 6354 bp, Homo sapiens
  Payload ID: 8582
  Gene Symbol: ITCH
  Gene Name: itchy E3 ubiquitin protein ligase
  Uniprot ID: Q96J02
  ENST ID: ENST00000621101
  CDS Start-End: 45-2756
agtgtctcctttgccatgttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaaatggggtttcgctctgtttgcccaggctggagtgcaatagtgcgatctcggctcactgcaacctctgcctcccgggtttaagtgattctcctatctcagcctcccgagtagctgggtttacaggtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttc

SEQ ID NO: 144669 - DNA, 6231 bp, Homo sapiens
  Payload ID: 8582
  Gene Symbol: ITCH
  Gene Name: itchy E3 ubiquitin protein ligase
  Uniprot ID: Q96J02
  ENST ID: ENST00000610336
  CDS Start-End: 45-2633
agtgtctcctttgccatgttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttc

SEQ ID NO: 144670 - DNA, 2958 bp, Homo sapiens
  Payload ID: 8583
  Gene Symbol: IWS1
  Gene Name: IWS1 homolog (S. cerevisiae)
  Uniprot ID: Q96ST2
  ENST ID: ENST00000295321
  CDS Start-End: 261-2720
ggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggtttttggg

SEQ ID NO: 144671 - DNA, 1080 bp, Homo sapiens
  Payload ID: 8583
  Gene Symbol: IWS1
  Gene Name: IWS1 homolog (S. cerevisiae)
  ENST ID: ENST00000409725
  CDS Start-End: 203-1080
atactacaagtcccagtgagcaacgcccgctttcttgcctactgcgggcgggaaccaggcgcctctgggcctgacgggaaagacagtggtttggctgaatgacggaaaagtcatttgagcaggtcttcatttttcggaagagtatctcaaaagctcttcaaacaaggcacggacacagaatctaggaaatgataaagaatcaatgataacgttattaccacgggggtcagaccaggatccacccgaggaagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtga

SEQ ID NO: 144672 - DNA, 441 bp, Homo sapiens
  Payload ID: 8583
  Gene Symbol: IWS1
  Gene Name: IWS1 homolog (S. cerevisiae)
  ENST ID: ENST00000412979
  CDS Start-End: 1-102
ccaatgccttcaaacaaggactatgttgtcaggcccaaatggaatgtggaaatggagtcatccagggttttgctgttactgctcagtgtagtcacaccttgaataagaaatggaaaaccttgggatgttgataaagctaatatcctgaggaagaacttcagtgggtcccagctgagtaggagatgggattcaacagtactggtctaatgtgctggagtggcccaggcggaggcccacttgcagagactaatgggagcctcaagagaaaatctaccataagaaaaggaccagtctgatagcaagcccagcttcccaagaagatagaaggttggaggcaagctgctgtccagaactcgcacacaaagcagcatgagacagaagcttttgaaggggagtggaatggcttttaccggcagtgcagttttcttcttgcaccagtgt

SEQ ID NO: 144673 - DNA, 728 bp, Homo sapiens
  Payload ID: 8584
  Gene Symbol: IZUMO2
  Gene Name: IZUMO family member 2
  Uniprot ID: Q6UXV1
  ENST ID: ENST00000293405
  CDS Start-End: 2-667
catgcctctggctttgacccttctgctgctctcgggcttgggcgcccccggaggctggggctgcctgcagtgcgaccccttggtgctggaggccctgggtcacctgcgctccgccctcatccccagtcgcttccagttggagcagctgcaggcgcgcgccggggccgtgctgatgggcatggaggggcctttcttccgggactacgcgctgaacgtgtttgtggggaaagtggagacaaatcaactggaccttgtggcgtcctttgtcaagaaccaaacgcagcacttaatgggtaactctctgaaagatgagcctctgctggaagagctggtgaccctcagggcgaatgtgatcaaggaattcaagaaagttttaatttcatatgaattaaaagcctgcaaccccaaactttgccgcttgctaaaagaagaggtgttggactgtttacattgccagaggatcactcccaagtgtatccacaaaaagtactgctttgtcgaccggcaaccccgcgtggccctgcagtaccagatggacagcaaatacccgaggaaccaggcgctgttgggcatcctcatttctgtgtctctggctgtctttgtcttcgtggtcatcgtggtctcggcttgtacatacagacaaaaccgaaaactcctgctgcagtaggacggtggtttgggggtaaggagaaaggaaaataaatttaataaaattggtgacaaatcca

SEQ ID NO: 144674 - DNA, 893 bp, Homo sapiens
  Payload ID: 8584
  Gene Symbol: IZUMO2
  Gene Name: IZUMO family member 2
  ENST ID: ENST00000594854
  CDS Start-End: 1-269
agtgcgaccccttggtgctggaggccctgggtcacctgcgctccgccctcatccccagtcgcttccagttggagcagctgcaggcgcgcgccggggccgtgctgatgggcatggaggggcctttcttccgggactacgcgctgaacgtgtttgtggggaaagtggagacaaatcaactggaccttgtggcgtcctttgtcaagaaccaaacgcagcacttaatgggtaactctctgaaagcagccgggcacggtggctcatgcctgtaatcccagcactttgggatgccgagacaggtggatcgcctgaggtcaggaattcaagactagcctggccaacatggtaaaaccccgtctctactaaaaatacaaaaattagccaggtgtggtggcgggcacctgtaatcccagctactcaggctgaggcaggagaatcacttgaacctaggaggcagaggttgcagtgagcaaagatcacgccattgcactccagcctgggcgacaagagcaaaactccgtttgaaaaaaaaaaaaaaaattctagtagtcacatttttaaaaagcacatctcaattcagactagcctatttcaagtgttcagtagccatgtgtggctagtggctaccacactggacagtgcacgtctaggtaatatataaagccatatggattgaaatcatgaaggagtgagtgtagacacaaaaaagaagaggtcgggtgcggtggctcacgtctgtaatcccagcactttgggaggccgaggtgggaggatcacctgaggtcaggagtttgaaaccagcctggccaacatggcgaaaccctgtctctactaaaaatacaaaaaattagccaggtgtgatggcacgtgcccgtaatcccagctatttgggaggc

SEQ ID NO: 144675 - DNA, 668 bp, Homo sapiens
  Payload ID: 8584
  Gene Symbol: IZUMO2
  Gene Name: IZUMO family member 2
  ENST ID: ENST00000486050
  CDS Start-End: 1-280
gacccttctgctgctctcgggcttgggcgcccccggaggctggggctgcctgcagtgcgaccccttggtgctggaggccctgggtcacctgcgctccgccctcatccccagtcgcttccagttggagcagctgcaggcgcgcgccggggccgtgctgatgggcatggaggggcctttcttccgggactacgcgctgaacgtgtttgtggggaaagtggacaaatcaactggaccttgtggcgtcctttgtcaagaaccaaacgcagcacttaatgggtaactctctgaaagatgagcctctgctggaagagctggtgaccctcagggcgaatgtgatcaaggaattcaagaaagttttaatttcatatgaattaaaagcctgcaaccccaaactttgccgcttgctaaaagaagaggtgttggactgtttacattgccagaggatcactcccaagtgtatccacaaaaagtactgctttgtcgaccggcaaccccgcgtggccctgcagtaccagatggacagcaaatacccgaggaaccaggcgctgttgggcatcctcatttctgtgtctctggctgtctttgtcttcgtggtcatcgtggtctcggcttgtacatacagacaaaaccgaaaactcctgctgcagtaggacggtggtttgggggta

SEQ ID NO: 144676 - DNA, 818 bp, Homo sapiens
  Payload ID: 8584
  Gene Symbol: IZUMO2
  Gene Name: IZUMO family member 2
  ENST ID: ENST00000600293
  CDS Start-End: 1-703
gggcgcccccggaggctggggctgcctgcagtgcgaccccttggtgctggaggccctgggtcacctgcgctccgccctcatccccagtcgcttccagttggagcagctgcaggcgcgcgccggggccgtgctgatgggcatggaggggcctttcttccgggactacgcgctgaacgtgtttgtggggaaagtggagacaaatcaactggaccttgtggcgtcctttgtcaagaaccaaacgcagcacttaatgggtaactctctgaaagatgagcctctgctggaagagctggtgaccctcagggcgaatgtgatcaaggaattcaagaaagttttaatttcatatgaattaaaagcctgcaaccccaaactttgccgcttgctaaaagaagaggtgttggactgtttacattgccagaggatcactcccaagtgtatccacaaaaagtactgctttgtcgaccggcaaccccgcgtggccctgcagtaccagatggacagcaaatacccgaggaaccaggcgctgttgggcatcctcatttctgtgtctctggctgtctttgtcttcgtggtcatcgtggtctcatggagtctcgctctgtggcccaagctggagtgcaatggcgcgatcttgcgaccttggctcactgcaaccgctgcctctcaggttcaagcgattcttctgcctcagcctcctgagtagctgggactacagggcttgtacatacagacaaaaccgaaaactcctgctgcagtaggacggtggtttgggggtaaggagaaaggaaaataaatttaataaaattggtgacaaatcc

SEQ ID NO: 144677 - DNA, 381 bp, Homo sapiens
  Payload ID: 8585
  Gene Symbol: IZUMO3
  Gene Name: IZUMO family member 3
  ENST ID: ENST00000418122
  CDS Start-End: 1-381
tctgcttgtgtgagctcaaggcttctctatctcttggtgttctacactcagaactcaggtgtctttatctatcaaggcaagcttctcgatgtctgccaaaacctggaatccaaactgaaagaattactaaagaacttctctgaaattgttgtggttgaaggtcccattcttgattgttggacgtgtcttcgcatgactaacaggtgcttcaaaggagaatattgtggagacgaggatccaagaaaggctgagaatcgagagattgctctatttctcatattgctggcaacagctgtaatactgggaagtgctgtgttactattccatttttgcatctttcatcggaggaaaatgaaggcaatacgaaggtcgctaaaggaa

SEQ ID NO: 144678 - DNA, 1229 bp, Homo sapiens
  Payload ID: 8585
  Gene Symbol: IZUMO3
  Gene Name: IZUMO family member 3
  Uniprot ID: Q5VZ72
  ENST ID: ENST00000543880
  CDS Start-End: 233-952
ctccccagctggcagttccctctcctagaatgaaggataatagtcagtaaacaactaaagatcattaaactaaacaactaaagattgcccgatagtgggatggaaacagcgggaaaagtggagtcagactatccagaaccaggctctcattcccggatttttgaaggaaaaggaactaagtgaactagttgccaggacaacctgctgtcggggagcgggggtgaagaaagaaatgggtgacctgtggttattcctgctcctgcccctctcagccttccatggagtcaaaggctgtttagaatgtgaccccaaatttatagaggatgttggctccttgctgggaaatctgataccttcagaagtccccggccgaactcagctgcttgaacggcagattaaggagatgattcatttaagcttcaaggtctcccacagtgacaagaggcttcgggtgttggctgttcagcaggttgttaagttgagaacatggttgaagaatgaattttataaactgggcaatgaaacatggaaaggtgtctttatctatcaaggcaagcttctcgatgtctgccaaaacctggaatccaaactgaaagaattactaaagaacttctctgaaattgcttgttctgaagattgcattgtggttgaaggtcccattcttgattgttggacgtgtcttcgcatgactaacaggtgcttcaaaggagaatattgtggagacgaggatccaagaaaggctgagaatcgagagattgctctatttctcatattgctggcaacagctgtaatactgggaagtgctgtgttactattccatttttgcatctttcatcggaggaaaatgaaggcaatacgaaggtcgctaaaggaatatgtggagaagaaacttgaagaattaatggggaagatagatgagaaggaggagaaagactttagactcagaaaataaacacatcaacatggacaagaagtctttcatgattctcttaagtgttgactctaagtacaaaactgggaggtaaaccctttcttggtcataaagtcatagtattttaaaactgaaatagaacttagagtttctctaatgaaaatgcttattgatatcctgagacaacggaagtaatgggagagcaaataatttggccagagttgtacagaaagtaatgctggtatgttgcaatgcacaggaaagataatatgctggatagtaataaataatgcatcgt

SEQ ID NO: 144679 - DNA, 743 bp, Homo sapiens
  Payload ID: 8585
  Gene Symbol: IZUMO3
  Gene Name: IZUMO family member 3
  ENST ID: ENST00000604921
  CDS Start-End: 28-729
tgtcggggagcgggggtgaagaaagaaatgggtgacctgtggttattcctgctcctgcccctctcagccttccatggagtcaaaggctgtttagaatgtgaccccaaatttatagaggatgttggctccttgctgggaaatctgataccttcagaagtccccggccgaactcagctgcttgaacggcagattaaggagatgattcatttaagcttcaaggtctcccacagtgacaagaggcttcgggtgttggctgttcagcaggttgttaagttgagaacatggttgaagaatgaattttataaactgggcaatgaaacatggaaaggtgtctttatctatcaaggcaagcttctcgatgtctgccaaaacctggaatccaaactgaaagaattactaaagaacttctctgaaattgttgtggttgaaggtcccattcttgattgttggacgtgtcttcgcatgactaacaggtgcttcaaaggagaatattgtggagacgaggatccaagaaaggctgagaatcgagagattgctctatttctcatattgctggcaacagctgtaatactgggaagtgctgtgttactattccatttttgcatctttcatcggaggaaaatgaaggcaatacgaaggtcgctaaaggaatatgtggagaagaaacttgaagaattaatggggaagatagatgagaaggaggagaaagactttagactcagaaaataaacacatcaacatgg

SEQ ID NO: 144680 - DNA, 869 bp, Homo sapiens
  Payload ID: 8586
  Gene Symbol: IZUMO4
  Gene Name: IZUMO family member 4
  ENST ID: ENST00000395296
  CDS Start-End: 4-630
ggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaacctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctc

SEQ ID NO: 144681 - DNA, 1021 bp, Homo sapiens
  Payload ID: 8586
  Gene Symbol: IZUMO4
  Gene Name: IZUMO family member 4
  Uniprot ID: Q1ZYL8
  ENST ID: ENST00000395301
  CDS Start-End: 78-776
ggccgttggttggtgcgcggctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagaccacgctcctctgccttctcctggcctgggacacacagagccaccccggccttcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgca

SEQ ID NO: 144682 - DNA, 944 bp, Homo sapiens
  Payload ID: 8586
  Gene Symbol: IZUMO4
  Gene Name: IZUMO family member 4
  Uniprot ID: Q1ZYL8
  ENST ID: ENST00000395307
  CDS Start-End: 65-709
tgcgcggctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagcctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtt

SEQ ID NO: 144683 - DNA, 864 bp, Homo sapiens
  Payload ID: 8586
  Gene Symbol: IZUMO4
  Gene Name: IZUMO family member 4
  ENST ID: ENST00000591894
  CDS Start-End: 1-415
gtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttca

SEQ ID NO: 144684 - DNA, 707 bp, Homo sapiens
  Payload ID: 8586
  Gene Symbol: IZUMO4
  Gene Name: IZUMO family member 4
  ENST ID: ENST00000610800
  CDS Start-End: 1-459
gtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagcatcttccagtacgagaccatctcctgcaacaactgcacagactcgcacgtcgcctgctttggctataactgcgagtcctcggcgcagtggaagtcagctgtccagggcctcctgaactacataaataactggcacaacctggtatcgccagccttaaggtgtctggagcccccacacttggccaacctgaccttggaagatgctgctgagtgtctcaagcagcactgacagcagctgggcctgccccagggcaacgtgggggcggagactcagctggacagcccctgcctgtcactctggagctgggctgctgctgcctcaggaccccctctccgaccccggacagagctgagctggccagggccaggagggcgggagggagggaatgggggtgggctgtgcgcagcatcagcgcctgggcaggtccgcagagctgcgggatgtgattaaagtccctgatgtttctctttgcagaa

SEQ ID NO: 144685 - DNA, 947 bp, Homo sapiens
  Payload ID: 8586
  Gene Symbol: IZUMO4
  Gene Name: IZUMO family member 4
  ENST ID: ENST00000620263
  CDS Start-End: 16-570
cgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccggtaaggggcgcgaaaccgaggcggggcccccccaccccgggacaccccgcccaccgcctgagcctgaccttctcctgcctcgacgactcagggtatttccccaacgagctgcgaaacatcttccgggagcaggtgcacctcatccagaacgccatcatcgaaagccgcatcgactgtcagcaccgctgtggtcctcggcgcagtggaagtcagctgtccagggcctcctgaactacataaataactggcacaagtaagtcccctcctcaaaccaacacaggcagtgtgtgtatgtgagcacctcgtgggtgagtatgtgtggggcacaggctggctccctcagctcccacgtcctagaggggctcccgaggaggtggaacctcaacccagctctgcgcaggaggcggctgcagtccttttctccctcaaaggtctccgaccctcagctggaggcgggcatctttcctaaagggtccccatagggtctggttccaccccatcccaggtctgtggtcagagcctgggagggttccctacgatggttaggggtgccccatggaggggctgactgccccacattgcctttcagacaggacacgagcatgaggtaaggccgccctgacctggacttcag

SEQ ID NO: 144686 - DNA, 510 bp, Homo sapiens
  Payload ID: 8586
  Gene Symbol: IZUMO4
  Gene Name: IZUMO family member 4
  ENST ID: ENST00000588003
  CDS Start-End: 1-457
gccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggtcctcggcgcagtggaagtcagctgtccagggcctcctgaactacataaataactggcacaaaccacgctcctctgccttctcctggcctgggacacacagagccaccccggccttgtgagtgacccagagaagggaggcctcgggagaaggggtgctcgtaagccaacacca

SEQ ID NO: 144687 - DNA, 1621 bp, Homo sapiens
  Payload ID: 8587
  Gene Symbol: IZUMO1
  Gene Name: izumo sperm-egg fusion 1
  Uniprot ID: Q8IYV9
  ENST ID: ENST00000332955
  CDS Start-End: 549-1601
ggaatatctataaaggaattcgggcccctacgtgagaagctcggagggggtggtttcaggagttccttgtggagaggggatcgtccgtgactcagaccccgtcgaaaagctctcgatttcacgcaaccaaccttaccctcgtccccaacacaatccttgattttacccctgggaaaattagcgtaggtggtcatgaccccggcttcctctttaaaagccctcagaacctggaccgggctcctcaatgaaccctagtgttagaggccacaaatcgggaaccaaggtcggggagcggctgtttagggtgcatcactgttcaggatgcatcggggctcctttttctaagcggaagggtgcgccctgcaaattgggagcccgttagttttggggaagggtgaacaagggccccctaggtctagaggaccgcatggagtctcgcttaagtgttagtggggtcctcagttctaggaatctgcgttctcctgctctcggtttggggtgagagcacccttcctaacggtcttcgggaactgtgcgcgccggctgcaatggggccgcattttaccctcctgtgtgcggcgctggccggttgcttgcttcctgccgaggggtgtgttatatgtgacccgtctgtcgtgctggcgctaaagtccctggagaaagattacctgcctggccacctggatgcgaagcatcacaaagccatgatggaaagggtagagaatgccgtgaaggatttccaggaactgtcgcttaatgaggatgcctatatgggggtcgttgatgaggccacactgcaaaaggggtcctggagtttgctgaaggatctgaaacgcatcacagacagtgatgtaaaaggcgatctcttcgtgaaggagctattttggatgttgcacttgcaaaaggaaacctttgccacctatgttgctcgattccaaaaagaggcttattgtcccaacaaatgtggtgtgatgttgcaaactctgatctggtgcaagaactgcaaaaaggaggttcacgcttgtcgaaagtcctacgattgcggggagcggaatgtggaagttcctcaaatggaagacatgatcctggactgtgagttaaactggcatcaggcttcggaaggcctcactgattacagcttttacagggtttgggggaacaatacggagaccttggtgtccaaggggaaagaggccaccctgaccaagcccatggtgggtccagaggatgcaggcagctaccgctgcgagctgggctctgtgaattccagcccagccacgatcatcaattttcacgtcacagtgttgcccaaaatgatcaaggaggaaaaaccttctccaaatatcgtaaccccgggggaggcgaccacggagtcgtccataagcctccagcctctgcagcccgagaaaatgctggcaagccgccttctggggctgctgatctgcggctccctagcactgataaccggccttacctttgcgatatttcgtcgaaggaaggtgatcgatttcatcaaatcctcactgtttggccttggcagtggagcggccgagcaaacccaggtcccaaaagaaaaggccacagattcgaggcaacaataaagatttatcttgttgtctaa

SEQ ID NO: 144688 - DNA, 1090 bp, Homo sapiens
  Payload ID: 8587
  Gene Symbol: IZUMO1
  Gene Name: izumo sperm-egg fusion 1
  Uniprot ID: Q8IYV9
  ENST ID: ENST00000595937
  CDS Start-End: 1-585
atggggccgcattttaccctcctgtgtgcggcgctggccggttgcttgcttcctgccgaggggtgtgttatatgtgacccgtctgtcgtgctggcgctaaagtccctggagaaagattacctgcctggccacctggatgcgaagcatcacaaagccatgatggaaagggtagagaatgccgtgaaggatttccaggaactgtcgcttaatgaggatgcctatatgggggtcgttgatgaggccacactgcaaaaggggtcctggagtttgctgaaggatctgaaacgcatcacagacagtgatgtaaaaggcgatctcttcgtgaaggagctattttggatgttgcacttgcaaaaggaaacctttgccacctatgttgctcgattccaaaaagaggcttattgtcccaacaaatgtggtgtgatgttgcaaactctgatctggtgcaagaactgcaaaaaggaggttcacgcttgtcgaaagtcctacgattgcgggggtgagagaactggacccagcaggaggaattggtgcagagcggaatgtggaagttcctcaaatggaagacatgatcctggactgtgagttaaactggcatcaggcttcggaaggcctcactgattacagcttttacagggtttgggggaacaatacggagaccttggtgtccaaggggaaagaggccaccctgaccaagcccatggtgggtccagaggatgcaggcagctaccgctgcgagctgggctctgtgaattccagcccagccacgatcatcaattttcacgtcacagtgttgcccaaaatgatcaaggaggaaaaaccttctccaaatatcgtaaccccgggggaggcgaccacggagtcgtccataagcctccagcctctgcagcccgagaaaatgctggcaagccgccttctggggctgctgatctgcggctccctagcactgataaccggccttacctttgcgatatttcgtcgaaggaaggtgatcgatttcatcaaatcctcactgtttggccttggcagtggagcggccgagcaaacccaggtcccaaaagaaaaggccacagattcgaggcaacaataa

SEQ ID NO: 144689 - DNA, 221 bp, Homo sapiens
  Payload ID: 8587
  Gene Symbol: IZUMO1
  Gene Name: izumo sperm-egg fusion 1
  ENST ID: ENST00000602105
  CDS Start-End: 175-221
tcgatttcacgcaaccaaccttaccctcgtccccaacacaatccttgattttacccctgggaaaattagcatgaggccacactgcaaaaggggtcctggagtttgctgaaggatctgaaacgcatcacagacagtgatgtaaaaggcgatctcttcgtgaaggagctattttggatgttgcacttgcaaaaggaaacctttgccacctatgttgctcgatt

SEQ ID NO: 144690 - DNA, 1016 bp, Homo sapiens
  Payload ID: 8587
  Gene Symbol: IZUMO1
  Gene Name: izumo sperm-egg fusion 1
  Uniprot ID: Q8IYV9
  ENST ID: ENST00000595517
  CDS Start-End: 1-207
atggggccgcattttaccctcctgtgtgcggcgctggccggttgcttgcttcctgccgaggggtgtgttatatgtgacccgtctgtcgtgctggcgctaaagtccctggagaaagattacctgcctggccacctggatgcgaagcatcacaaagccatgatggaaaggatgaggccacactgcaaaaggggtcctggagtttgctgaaggatctgaaacgcatcacagacagtgatgtaaaaggcgatctcttcgtgaaggagctattttggatgttgcacttgcaaaaggaaacctttgccacctatgttgctcgattccaaaaagaggcttattgtcccaacaaatgtggtgtgatgttgcaaactctgatctggtgcaagaactgcaaaaaggaggttcacgcttgtcgaaagtcctacgattgcggggagcggaatgtggaagttcctcaaatggaagacatgatcctggactgtgagttaaactggcatcaggcttcggaaggcctcactgattacagcttttacagggcctcagtgaccccttgagcttgggtctaggtttgggggaacaatacggagaccttggtgtccaaggggaaagaggccaccctgaccaagcccatggtgggtccagaggatgcaggcagctaccgctgcgagctgggctctgtgaattccagcccagccacgatcatcaattttcacgtcacagtgttgcccaaaatgatcaaggaggaaaaaccttctccaaatatcgtaaccccgggggaggcgaccacggagtcgtccataagcctccagcctctgcagcccgagaaaatgctggcaagccgccttctggggctgctgatctgcggctccctagcactgataaccggccttacctttgcgatatttcgtcgaaggaaggtgatcgatttcatcaaatcctcactgtttggccttggcagtggagcggccgagcaaacccaggtcccaaaagaaaaggccacagattcgaggcaacaataa

SEQ ID NO: 144691 - DNA, 583 bp, Homo sapiens
  Payload ID: 8588
  Gene Symbol: IZUMO1R
  Gene Name: IZUMO1 receptor, JUNO
  ENST ID: ENST00000328458
  CDS Start-End: 1-583
tcctgctagagctgtggacagtcatgcccacctgggctggggacgagctgctcaacatctgcatgaatgccaaacaccacaagagagtgcccagcccagaagacaagctctatgaggagtgcatcccctggaaggacaatgcctgctgcaccctcacgacaagctgggaagcccatctggatgtatccccactctacaacttcagcctgtttcactgtggactgctgatgcctggctgtcggaagcacttcatccaggctatctgcttctatgagtgctccccaaacctggggccctggatccagccagtgggaagcctggggtgggaggtggccccgagtgggcagggagagcgagttgtgaatgtgccgctgtgccaggaggactgtgaggagtggtgggaagactgtcgcatgtcttacacatgcaaatccaactggcgtggtggctgggactggagtcaggggaagaaccgctgccccaaaggggcccagtgcctccctttctcccattacttccccaccccagctgacctgtgtgagaagacttggagcaattccttcaaagccagccctgagcgacg

SEQ ID NO: 144692 - DNA, 805 bp, Homo sapiens
  Payload ID: 8588
  Gene Symbol: IZUMO1R
  Gene Name: IZUMO1 receptor, JUNO
  Uniprot ID: A6ND01
  ENST ID: ENST00000440961
  CDS Start-End: 45-776
tcatttccatcaagtgtgcagcatgggtctctctgtagcaggccatggcatgctggtggccgctcctgctagagctgtggacagtcatgcccacctgggctggggacgagctgctcaacatctgcatgaatgccaaacaccacaagagagtgcccagcccagaagacaagctctatgaggagtgcatcccctggaaggacaatgcctgctgcaccctcacgacaagctgggaagcccatctggatgtatccccactctacaacttcagcctgtttcactgtggactgctgatgcctggctgtcggaagcacttcatccaggctatctgcttctatgagtgctccccaaacctggggccctggatccagccagtggccccgagtgggcagggagagcgagttgtgaatgtgccgctgtgccaggaggactgtgaggagtggtgggaagactgtcgcatgtcttacacatgcaaatccaactggcgtggtggctgggactggagtcaggggaagaaccgctgccccaaaggggcccagtgcctccctttctcccattacttccccaccccagctgacctgtgtgagaagacttggagcaattccttcaaagccagccctgagcgacggaacagtgggcggtgtctccagaagtggtttgagcctgctcagggcaaccccaatgtggccgtggcccgcctcttcgccagctctgccccatcctgggaactgtcctacaccatcatggtctgctccctgttcctgccgttcctttcctgagagcccttcttctcccactcacattcctg

SEQ ID NO: 144693 - DNA, 5772 bp, Homo sapiens
  Payload ID: 8589
  Gene Symbol: JADE1
  Gene Name: jade family PHD finger 1
  Uniprot ID: Q6IE81
  ENST ID: ENST00000226319
  CDS Start-End: 282-2810
cgttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaataca

SEQ ID NO: 144694 - DNA, 5544 bp, Homo sapiens
  Payload ID: 8589
  Gene Symbol: JADE1
  Gene Name: jade family PHD finger 1
  Uniprot ID: Q6IE81
  ENST ID: ENST00000452328
  CDS Start-End: 90-2582
atgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaataca

SEQ ID NO: 144695 - DNA, 4012 bp, Homo sapiens
  Payload ID: 8589
  Gene Symbol: JADE1
  Gene Name: jade family PHD finger 1
  Uniprot ID: Q6IE81
  ENST ID: ENST00000413543
  CDS Start-End: 105-1634
acggcacccgccagtgggggtgcctcaacttccgcgggcgtttaaatagcagcctctctcccctcccaccggtaataggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactacc

SEQ ID NO: 144696 - DNA, 564 bp, Homo sapiens
  Payload ID: 8589
  Gene Symbol: JADE1
  Gene Name: jade family PHD finger 1
  ENST ID: ENST00000510308
  CDS Start-End: 136-564
gctcaaagtggcggagcgcggcggcgggaggcaggtgcacggcacccgccagtgggggtgcctcaacttccgcgggcgtttaaatagcagcctctctcccctcccaccggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctc

SEQ ID NO: 144697 - DNA, 529 bp, Homo sapiens
  Payload ID: 8589
  Gene Symbol: JADE1
  Gene Name: jade family PHD finger 1
  ENST ID: ENST00000511925
  CDS Start-End: 132-281
aaagtggcggagcgcggcggcgggaggcaggtgcacggcacccgccagtgggggtgcctcaacttccgcgggcgtttaaatagcagcctctctcccctcccaccggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaata

SEQ ID NO: 144698 - DNA, 584 bp, Homo sapiens
  Payload ID: 8589
  Gene Symbol: JADE1
  Gene Name: jade family PHD finger 1
  ENST ID: ENST00000503785
  CDS Start-End: 196-584
gcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtgga

SEQ ID NO: 144699 - DNA, 3560 bp, Homo sapiens
  Payload ID: 8589
  Gene Symbol: JADE1
  Gene Name: jade family PHD finger 1
  Uniprot ID: Q6IE81
  ENST ID: ENST00000511647
  CDS Start-End: 202-1731
cataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgta

SEQ ID NO: 144700 - DNA, 552 bp, Homo sapiens
  Payload ID: 8589
  Gene Symbol: JADE1
  Gene Name: jade family PHD finger 1
  ENST ID: ENST00000507833
  CDS Start-End: 158-552
gatacacagtttccagaactgtctgggggcgggagcgggagcgggagccgagcccgctcggagctcctcgccgccgctgccgctcccatcttaaaaccgtttctcgccggcgcgcccgccccagcccgaaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccg

SEQ ID NO: 144701 - DNA, 504 bp, Homo sapiens
  Payload ID: 8589
  Gene Symbol: JADE1
  Gene Name: jade family PHD finger 1
  ENST ID: ENST00000508997
  CDS Start-End: 148-504
gctaaagattcctggagtagttatagtaataatgtcacaggaatatagaaagaaacctggcatctttgggagacctactgatatgtgacttctccacccctccccctccttttttaacctggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatca

SEQ ID NO: 144702 - DNA, 3000 bp, Homo sapiens
  Payload ID: 8589
  Gene Symbol: JADE1
  Gene Name: jade family PHD finger 1
  Uniprot ID: Q6IE81
  ENST ID: ENST00000512960
  CDS Start-End: 400-2928
cgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtggggg

SEQ ID NO: 144703 - DNA, 567 bp, Homo sapiens
  Payload ID: 8589
  Gene Symbol: JADE1
  Gene Name: jade family PHD finger 1
  ENST ID: ENST00000504089
  CDS Start-End: 158-567
agcccagcgcctcggccgaacccctccgcagcagttcatagccctgatgaagcaagttactctgctctcctaataaatgcaagaaaatgaccttggagggcctttttaattacacatagaagtgacaatttgctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacag

SEQ ID NO: 144704 - DNA, 532 bp, Homo sapiens
  Payload ID: 8589
  Gene Symbol: JADE1
  Gene Name: jade family PHD finger 1
  ENST ID: ENST00000514740
  CDS Start-End: 480-532
atatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcagttcatagccctgatgaagcaagttactctgctctcctaataaatgcaagaaaatgaccttggagggcctttttaattacacatagaagtgacaatttgctgcctgctgtttcccggggagatcatgaaacgaggtcgccttcccagcagcagtgaggattctgacgacaatggcag

SEQ ID NO: 144705 - DNA, 5648 bp, Homo sapiens
  Payload ID: 8589
  Gene Symbol: JADE1
  Gene Name: jade family PHD finger 1
  Uniprot ID: Q6IE81
  ENST ID: ENST00000611140
  CDS Start-End: 158-2686
gatacacagtttccagaactgtctgggggcgggagcgggagcgggagccgagcccgctcggagctcctcgccgccgctgccgctcccatcttaaaaccgtttctcgccggcgcgcccgccccagcccgaaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaataca

SEQ ID NO: 144706 - DNA, 5644 bp, Homo sapiens
  Payload ID: 8589
  Gene Symbol: JADE1
  Gene Name: jade family PHD finger 1
  Uniprot ID: Q6IE81
  ENST ID: ENST00000610919
  CDS Start-End: 154-2682
gctgaggacgcggctgctgctcaaagtggcggagcgcggcggcgggaggcaggtgcacggcacccgccagtgggggtgcctcaacttccgcgggcgtttaaatagcagcctctctcccctcccaccggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaataca

SEQ ID NO: 144707 - DNA, 2748 bp, Homo sapiens
  Payload ID: 8590
  Gene Symbol: JADE2
  Gene Name: jade family PHD finger 2
  ENST ID: ENST00000282605
  CDS Start-End: 87-2591
tttaaaaagaaacagaaacatacacagggggttggtgaatggtgccgaccgcggccatcgcagttggaggctattttttgggggggatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctggcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattct

SEQ ID NO: 144708 - DNA, 3212 bp, Homo sapiens
  Payload ID: 8590
  Gene Symbol: JADE2
  Gene Name: jade family PHD finger 2
  ENST ID: ENST00000361895
  CDS Start-End: 340-2715
aacatacacagggggttggtgaatggtgccgaccgcggccatcgcagttggaggctattttttggggggggtgagtagcgtccatggagttactttgcgcccactcctagcggcaccggcttaggtcctgcgggccgaccgtccccggcggggggcgtggggcctgggacgccgcgggcccggccgcctccctcgccgcgaccccggatggatgcgcgccccccgccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtcta

SEQ ID NO: 144709 - DNA, 6465 bp, Homo sapiens
  Payload ID: 8590
  Gene Symbol: JADE2
  Gene Name: jade family PHD finger 2
  Uniprot ID: Q9NQC1
  ENST ID: ENST00000395003
  CDS Start-End: 180-2552
ctctcttgctcgctcgctccctctctctcctgctggctgcctgttctaggaagccagcgcggagaggggggggatgcacagcacaggggagagagattgcgcatgttggtcagtcgtgttttaaagagtacagtgcggggaggctgagaggggcgcatgcaacaacaacttttggaaggatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcagtgttttctgtgctg

SEQ ID NO: 144710 - DNA, 2797 bp, Homo sapiens
  Payload ID: 8590
  Gene Symbol: JADE2
  Gene Name: jade family PHD finger 2
  ENST ID: ENST00000402835
  CDS Start-End: 256-1785
ggtgagtagcgtccatggagttactttgcgcccactcctagcggcaccggcttaggtcctgcgggccgaccgtccccggcggggggcgtggggcctgggacgccgcgggcccggccgcctccctcgccgcgaccccggatggatgcgcgccccccgccctcccgcgccggccccaggagctcccggcttcgggagcatccttcccgcgccggtccctgcagcggcgcgtagccgagggcagcgcccgtcagggggatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagaggagcggtctgggaggagagcaaagggcaagaagagtgactcgaagaggaagggctgcgagggctccaagggcagcactgagaagaaagagaaagtgaaggcggggcctgactcagtcctggggcagctgggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattcta

SEQ ID NO: 144711 - DNA, 1256 bp, Homo sapiens
  Payload ID: 8590
  Gene Symbol: JADE2
  Gene Name: jade family PHD finger 2
  ENST ID: ENST00000430087
  CDS Start-End: 1-143
gtcgagagcggtctgggaggagagcaaagggcaagaagagtgactcgaagaggaagggctgcgagggctccaagggcagcactgagaagaaagagaaagtgaaggcggggcctgactcagtcctggggcagctgggtgagtgagggccatgctggcctgcagacacggcaggcttgaccatcaccacgcttgcagctctgtctgccctgcggaaggccagctgcacagagtaggagactgaggctcaagagcggtaaccaggcccttgcttgcccaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattcta

SEQ ID NO: 144712 - DNA, 887 bp, Homo sapiens
  Payload ID: 8590
  Gene Symbol: JADE2
  Gene Name: jade family PHD finger 2
  ENST ID: ENST00000431355
  CDS Start-End: 123-887
cccctctcccggcccggtgcacgcgggcgctgcacgcgggggcagcatgctcggctcctggggttggaggctctgcacaaattagacagtttttttggaggggcgggggacaccctttccagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctg

SEQ ID NO: 144713 - DNA, 567 bp, Homo sapiens
  Payload ID: 8590
  Gene Symbol: JADE2
  Gene Name: jade family PHD finger 2
  ENST ID: ENST00000512386
  CDS Start-End: 119-567
aacagacccaaggccccgccaccgccggctagcagcccgacagcccgcccgcctggcgagcgcaggctcttcttccagaaactgcgaggatccgagcgtactgtttgtgcaccacaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcat

SEQ ID NO: 144714 - DNA, 1251 bp, Homo sapiens
  Payload ID: 8590
  Gene Symbol: JADE2
  Gene Name: jade family PHD finger 2
  ENST ID: ENST00000612830
  CDS Start-End: 354-1094
agagcggtctgggaggagagcaaagggcaagaagagtgactcgaagaggaagggctgcgagggctccaagggcagcactgagaagaaagagaaagtgaaggcggggcctgactcagtcctggggcagctgggtgagtgagggccatgctggcctgcagacacggcaggcttgaccatcaccacgcttgcagctctgtctgccctgcggaaggccagctgcacagagtaggagactgaggctcaagagcggtaaccaggcccttgcttgcccaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattct

SEQ ID NO: 144715 - DNA, 636 bp, Homo sapiens
  Payload ID: 8591
  Gene Symbol: JADE3
  Gene Name: jade family PHD finger 3
  ENST ID: ENST00000424392
  CDS Start-End: 77-636
gggtggcgacggcgcccagcccgccagaagaacgcgcggcgggcagacggctgggagccgctccggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctat

SEQ ID NO: 144716 - DNA, 492 bp, Homo sapiens
  Payload ID: 8591
  Gene Symbol: JADE3
  Gene Name: jade family PHD finger 3
  ENST ID: ENST00000455411
  CDS Start-End: 149-492
ctccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactg

SEQ ID NO: 144717 - DNA, 4713 bp, Homo sapiens
  Payload ID: 8591
  Gene Symbol: JADE3
  Gene Name: jade family PHD finger 3
  Uniprot ID: Q92613
  ENST ID: ENST00000611250
  CDS Start-End: 77-2548
gggtggcgacggcgcccagcccgccagaagaacgcgcggcgggcagacggctgggagccgctccggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtcagcattgcttgtcctgagaggatggaaccgatcacgaagatctcccacatcccacccagtcggtgggccttagtctgcaacttgtgcaagttgaagacgggggcttgtattcagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtccgaaatctgtgctatatgataagcagacgagagaagctgaagctgtcacacaacaaaatacaggaacagatcttcggtttgcaagtccagcttcttaaccaagaaattgatgcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccactggtatctataaacccttttcaggggagagaccaggagaccaccatcttagatactgtcaaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgcta

SEQ ID NO: 144718 - DNA, 4934 bp, Homo sapiens
  Payload ID: 8591
  Gene Symbol: JADE3
  Gene Name: jade family PHD finger 3
  Uniprot ID: Q92613
  ENST ID: ENST00000614628
  CDS Start-End: 299-2770
atacaatagtgctccgcgccgcctcagccgccgccgccgcccaaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtcagcattgcttgtcctgagaggatggaaccgatcacgaagatctcccacatcccacccagtcggtgggccttagtctgcaacttgtgcaagttgaagacgggggcttgtattcagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtccgaaatctgtgctatatgataagcagacgagagaagctgaagctgtcacacaacaaaatacaggaacagatcttcggtttgcaagtccagcttcttaaccaagaaattgatgcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccactggtatctataaacccttttcaggggagagaccaggagaccaccatcttagatactgtcaaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgct

SEQ ID NO: 144719 - DNA, 6048 bp, Homo sapiens
  Payload ID: 8592
  Gene Symbol: JAG1
  Gene Name: jagged 1
  Uniprot ID: P78504
  ENST ID: ENST00000254958
  CDS Start-End: 578-4234
gggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcc

SEQ ID NO: 144720 - DNA, 597 bp, Homo sapiens
  Payload ID: 8592
  Gene Symbol: JAG1
  Gene Name: jagged 1
  ENST ID: ENST00000613518
  CDS Start-End: 1-518
gccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccagtgagtctgccactctttggggagctctgggatgtatgggtcatgttggagggatcccacttcaacgtgggaaaactttctttgtactggaaatctctggaagcaagaccgcagtgatttctgcactgggacagtatcacttgtgtctcatttgcatttatgagtcctgatgatagcttatggggaggagcttctgctgaggacctatagaattagactgtgtaataaatattcctgcttgcaaggaaa

SEQ ID NO: 144721 - DNA, 507 bp, Homo sapiens
  Payload ID: 8592
  Gene Symbol: JAG1
  Gene Name: jagged 1
  ENST ID: ENST00000622545
  CDS Start-End: 1-223
gtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcgg

SEQ ID NO: 144722 - DNA, 5835 bp, Homo sapiens
  Payload ID: 8593
  Gene Symbol: JAG2
  Gene Name: jagged 2
  Uniprot ID: Q9Y219
  ENST ID: ENST00000331782
  CDS Start-End: 405-4121
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgctgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggtaa

SEQ ID NO: 144723 - DNA, 5720 bp, Homo sapiens
  Payload ID: 8593
  Gene Symbol: JAG2
  Gene Name: jagged 2
  Uniprot ID: Q9Y219
  ENST ID: ENST00000347004
  CDS Start-End: 405-4007
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgtcaacgactgtcgcgggcagtgtcagcatgggggcacctgcaaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgctgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggta

SEQ ID NO: 144724 - DNA, 1693 bp, Homo sapiens
  Payload ID: 8594
  Gene Symbol: JAGN1
  Gene Name: jagunal homolog 1
  Uniprot ID: Q8N5M9
  ENST ID: ENST00000307768
  CDS Start-End: 170-721
gcgcggagaggagtgaccatagagtcggtcctccagagacagaggggccggaagttctcttcacggagccgcgcggctgcgggggcgcaaatagggtcagtgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgagtgtgactctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccacactgtgccttgtgtttggggcttgatagagtgtgaaaggtgtgttgcttgaaaggtgtggccttagacactaggagatgatgggtagaagctccttgagaaacctagcagtggccatagagaagtagactgggtatggggaacctaagtcatagttgtaacctacagctgattggtaagaactatgggccagacatttaatctctccatctatgaaatagtccattctcatttatctaccttaggttatgggctcttcttttagttggatattcacatttatctttcagtgttaactgggtatcagttatgagtctactactgtataatggcatccaaaagaattttaaagtacctcggtttatagggatttacaattcagtagaaacttgttattcatgtgaaacagtgaacataatatctaatgatgtggagcaagtacattaaaaacaggaaggaagagatctgtgattaaactaaaggccctttcacacctaaaa

SEQ ID NO: 144725 - DNA, 682 bp, Homo sapiens
  Payload ID: 8594
  Gene Symbol: JAGN1
  Gene Name: jagunal homolog 1
  ENST ID: ENST00000616966
  CDS Start-End: 137-682
cagagacagaggggccggaagttctcttcacggagccgcgcggctgcgggggcgcaaatagggtcagtgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgagtgtgactctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactctttcatcgctccactcatttatggcagcatggagatgttccctgctgcacagcagctaccgccatggcaaggcctaccgtttcctctttggtttttctgccgtttccaatgtacctggtgttggtgttggcagtgcaagtgcatgcctggcagttgtactacagcaagaagctcctagactcttggttcaccagcacacaggagaagaagcataaatga

SEQ ID NO: 144726 - DNA, 5047 bp, Homo sapiens
  Payload ID: 8595
  Gene Symbol: JAK1
  Gene Name: Janus kinase 1
  Uniprot ID: P23458
  ENST ID: ENST00000342505
  CDS Start-End: 250-3714
tgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgatgacaagatgtccctccggctccactaccggatgaggttctatttcaccaattggcatggaaccaacgacaatgagcagtcagtgtggcgtcattctccaaagaagcagaaaaatggctacgagaaaaaaaagattccagatgcaacccctctccttgatgccagctcactggagtatctgtttgctcagggacagtatgatttggtgaaatgcctggctcctattcgagaccccaagaccgagcaggatggacatgatattgagaacgagtgtctagggatggctgtcctggccatctcacactatgccatgatgaagaagatgcagttgccagaactgcccaaggacatcagctacaagcgatatattccagaaacattgaataagtccatcagacagaggaaccttctcaccaggatgcggataaataatgttttcaaggatttcctaaaggaatttaacaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaagtgatggtgactgggaatcttggaatccagtggaggcataaaccaaatgttgtttctgttgaaaaggaaaaaaataaactgaagcggaaaaaactggaaaataaacacaagaaggatgaggagaaaaacaagatccgggaagagtggaacaatttttcttacttccctgaaatcactcacattgtaataaaggagtctgtggtcagcattaacaagcaggacaacaagaaaatggaactgaagctctcttcccacgaggaggccttgtcctttgtgtccctggtagatggctacttccggctcacagcagatgcccatcattacctctgcaccgacgtggcccccccgttgatcgtccacaacatacagaatggctgtcatggtccaatctgtacagaatacgccatcaataaattgcggcaagaaggaagcgaggaggggatgtacgtgctgaggtggagctgcaccgactttgacaacatcctcatgaccgtcacctgctttgagaagtctgagcaggtgcagggtgcccagaagcagttcaagaactttcagatcgaggtgcagaagggccgctacagtctgcacggttcggaccgcagcttccccagcttgggagacctcatgagccacctcaagaagcagatcctgcgcacggataacatcagcttcatgctaaaacgctgctgccagcccaagccccgagaaatctccaacctgctggtggctactaagaaagcccaggagtggcagcccgtctaccccatgagccagctgagtttcgatcggatcctcaagaaggatctggtgcagggcgagcaccttgggagaggcacgagaacacacatctattctgggaccctgatggattacaaggatgacgaaggaacttctgaagagaagaagataaaagtgatcctcaaagtcttagaccccagccacagggatatttccctggccttcttcgaggcagccagcatgatgagacaggtctcccacaaacacatcgtgtacctctatggcgtctgtgtccgcgacgtggagaatatcatggtggaagagtttgtggaagggggtcctctggatctcttcatgcaccggaaaagcgatgtccttaccacaccatggaaattcaaagttgccaaacagctggccagtgccctgagctacttggaggataaagacctggtccatggaaatgtgtgtactaaaaacctcctcctggcccgtgagggcatcgacagtgagtgtggcccattcatcaagctcagtgaccccggcatccccattacggtgctgtctaggcaagaatgcattgaacgaatcccatggattgctcctgagtgtgttgaggactccaagaacctgagtgtggctgctgacaagtggagctttggaaccacgctctgggaaatctgctacaatggcgagatccccttgaaagacaagacgctgattgagaaagagagattctatgaaagccggtgcaggccagtgacaccatcatgtaaggagctggctgacctcatgacccgctgcatgaactatgaccccaatcagaggcctttcttccgagccatcatgagagacattaataagcttgaagagcagaatccagatattgtttcagaaaaaaaaccagcaactgaagtggaccccacacattttgaaaagcgcttcctaaagaggatccgtgacttgggagagggccactttgggaaggttgagctctgcaggtatgaccccgaaggggacaatacaggggagcaggtggctgttaaatctctgaagcctgagagtggaggtaaccacatagctgatctgaaaaaggaaatcgagatcttaaggaacctctatcatgagaacattgtgaagtacaaaggaatctgcacagaagacggaggaaatggtattaagctcatcatggaatttctgccttcgggaagccttaaggaatatcttccaaagaataagaacaaaataaacctcaaacagcagctaaaatatgccgttcagatttgtaaggggatggactatttgggttctcggcaatacgttcaccgggacttggcagcaagaaatgtccttgttgagagtgaacaccaagtgaaaattggagacttcggtttaaccaaagcaattgaaaccgataaggagtattacaccgtcaaggatgaccgggacagccctgtgttttggtatgctccagaatgtttaatgcaatctaaattttatattgcctctgacgtctggtcttttggagtcactctgcatgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcaacttatgaggaaatgctgggaattccaaccatccaatcggacaagctttcagaaccttattgaaggatttgaagcacttttaaaataagaagcatgaataacatttaaattccacagattatcaagtccttctcctgcaacaaatgcccaagtcattttttaaaaatttctaatgaaagaagtttgtgttctgtccaaaaagtcactgaactcatacttcagtacatatacatgtataaggcacactgtagtgcttaatatgtgtaaggacttcctctttaaatttggtaccagtaacttagtgacacataatgacaaccaaaatatttgaaagcacttaagcactcctccttgtggaaagaatataccaccatttcatctggctagttcaccatcacaactgcattaccaaaaggggatttttgaaaacgaggagttgaccaaaataatatctgaagatgattgcttttccctgctgccagctgatctgaaatgttttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatggggggatagctgtggaatagataatttgctgcatgttaattctcaagaactaagcctgtgccagtgctttcctaagcagtatacctttaatcagaactcattcccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaaagacccggctagaggcactatggacttcaggatccactagacagttttcagtttgcttggaggtagctgggtaatcaaaaatgtttagtcattgattcaatgtgaacgattacggtctttatgaccaagagtctgaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgtttactctttatacaaataaatatactaaagacttta

SEQ ID NO: 144727 - DNA, 5285 bp, Homo sapiens
  Payload ID: 8596
  Gene Symbol: JAK2
  Gene Name: Janus kinase 2
  Uniprot ID: O60674
  ENST ID: ENST00000381652
  CDS Start-End: 495-3893
ctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagctgagcccacactggagggcccccgagggcccagcctggaggtcgttcagagccgtgcccgtcccggggcttcgcagaccttgacccgccgggtaggagccgcccctgcgggctcgagggcgcgctctggtcgcccgatctgtgtagccggtttcagaagcaggcaacaggaacaagatgtgaactgtttctcttctgcagaaaaagaggctcttcctcctcctcccgcgacggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctggggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttttgtgtgtgtgtgtgtgtgtgtgtgtgtgtgtgtgtgtgtgttatttatacaaaacttaaaatacttgctgttttgattaaaaagaaaatagtttcttacttta

SEQ ID NO: 144728 - DNA, 5432 bp, Homo sapiens
  Payload ID: 8597
  Gene Symbol: JAK3
  Gene Name: Janus kinase 3
  Uniprot ID: P52333
  ENST ID: ENST00000458235
  CDS Start-End: 101-3475
cacacaggaaggagccgagtgggactttcctctcgctgcctcccggctctgcccgcccttcgaaagtccagggtccctgcccgctaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatagctcctgcccgcagacctctggattaggtctctgttgactggctgtgtgaccttaggcccggagctgcccctctctgggcctcagaggccttatgagggtcctctacttcaggaacacccccatgacattgcatttgggggggctcccgtggcctgtagaatagcctgtggcctttgcaatttgttaaggttcaagacagatgggcatatgtgtcagtggggctctctgagtcctggcccaaagaagcaaggaaccaaatttaagactctcgcatcttcccaaccccttaagccctggccccctgagtttccttttctgtctctctctttttattttttttatttttatttttatttttgagacagagcctcgctctgttacccagggtggagtgcagtggtgcgatctcggctcagtgcaacctctgcttcccaggttcaagcgattctcctgcctcagcctcccgagtagctgggattacaggtgtgcaccaccacacccggctaattttttttatttttaatagagatgaggtttcaccatgatggccaggctgatctcgaactcctaacctcaagtgatcctcccacctcagcctcccaaagtgttggaataataggcatgagccactgcacccaggcttttttttttttaaatttattattattatttttaagagacaggatcttgctacgttgcccaggctggtcttgaactcctgggctacagtgatcctcctgccttatcctcctaaatagctgggactacagcacctagttttgagtttcctgtcttatttccaatggggacattcatgtagctttttttttttttttttttttgagacggagtctcgctctgtcgcccaggctggagtacagtggcgcaatctaggctcactgcaagctccgcctcctgggttcacaccattctctcgcctcagcctcccaagtagctgggactacaggcgcccgccaccacacccggctaattttttgtatttttagtagagacggggtttcaccttgttagccaggatggtttccatctcctgacctcgtgatctgcccgtctcggcctcccaaagtgctgggattacaggcatgagccactgcgcccggccctcatgtagctttaaatgtatgatctgacttctgctccccgatctctgtttctctggaggaagccaaggacaagagcagttgctgtggctgggactctgccttttaggggagcccgtgtatctctttgggatcctgaaagggggcaggaaaggctggggtcccagtccaccctaatggtatctgagtgtcctagggcttcagttttcccacctgtccaatgggaccctttctgtcctcaccctacaaggggcacaaagggatgacaccaaacctggcaggaacttttcacgcaatcaagggaaggaaaggcattcctggcagagggaacagcatgccaagcgtgagaaggctcagagtaaggaggttaagagcccaagtattggagcctacagttttgccccttccatgcagtgtgacagtgggcaagttcctttccctctctgggtctcagttctgtcccctgcaaaatggtcagagcttaccccttggctgtgcagggtcaactttctgactggtgagagggattctcatgcaggttaagcttctgctgctcctcctcacctgcaaagcttttctgccacttttgcctccttggaaaactcttatccatctctcaaaactccagctaccacatccttgcagccttccctcatatacccccactactactgtagccctgtccttccctccagccccactctggccctggggctggggaagtgtctgtgtccagctgtctcccctgacctcagggttccttgggggctgggctgaggcctcagtacagagggggctctggaaatgtttgttgactgaataaaggaattcagtgg

SEQ ID NO: 144729 - DNA, 3996 bp, Homo sapiens
  Payload ID: 8597
  Gene Symbol: JAK3
  Gene Name: Janus kinase 3
  Uniprot ID: P52333
  ENST ID: ENST00000527670
  CDS Start-End: 31-3405
ttctctctgtgccccaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatagctcctgcccgcagacctctggattaggtctctgttgactggctgtgtgaccttaggcccggagctgcccctctctgggcctcagaggccttatgagggtcctctacttcaggaacacccccatgacattgcatttgggggggctcccgtggcctgtagaatagcctgtggcctttgcaatttgttaaggttcaagacagatgggcatatgtgtcagtggggctctctgagtcctggcccaaagaagcaaggaaccaaatttaagactctcgcatcttcccaaccccttaagccctggccccctgagtttccttttctgtctctctctttttattttttttatttttatttttatttttgagacagagcctcgctctgttacccagggtggagtgcagtggtgcgatctcggctcagtgcaacctctgcttcccaggttcaagcgattctcctgcctcagcctcccgagtagctgggattacaggtgtgcaccaccacacccggctaattttttttatttttaatagagatgaggtttcaccatgatggccaggctgatctcgaactcctaacctcaagtgatcctcccacc

SEQ ID NO: 144730 - DNA, 3612 bp, Homo sapiens
  Payload ID: 8597
  Gene Symbol: JAK3
  Gene Name: Janus kinase 3
  Uniprot ID: P52333
  ENST ID: ENST00000534444
  CDS Start-End: 86-3370
cgagtgggactttcctctcgctgcctcccggctctgcccgcccttcgaaagtccagggtccctgcccgctaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggtgagcgccgcagggctagcctcagtttcccagtctgtagattgggccggggtctcgggcaagccagctggcgcctgagtctctgtactgagaagaaaggctagagtgtgaggccgatgaggatcctggcccccacttggctactctctcactgtgtggcaagtcagagcactttcagagcctcagtttacccttttccaaaatgagaatagtaatgccttatagggtgagggaagattagactcctgaacacctgtgcctatgagggctcagctcaaagccgagcacacagtcgatgctccataaatggtggtgacgtt

SEQ ID NO: 144731 - DNA, 2585 bp, Homo sapiens
  Payload ID: 8598
  Gene Symbol: JAKMIP1
  Gene Name: janus kinase and microtubule interacting protein 1
  Uniprot ID: Q96N16
  ENST ID: ENST00000282924
  CDS Start-End: 487-2367
ggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaa

SEQ ID NO: 144732 - DNA, 2975 bp, Homo sapiens
  Payload ID: 8598
  Gene Symbol: JAKMIP1
  Gene Name: janus kinase and microtubule interacting protein 1
  Uniprot ID: Q96N16
  ENST ID: ENST00000409021
  CDS Start-End: 451-2946
agctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagagagagagaggaggtcgccagcatttaacctccaaatcaccaccttccccgagaaccacagcagcgctctccagctgttctgtcaccaggaaggagttaaggatgtgaatgtttctgaacttatgaagaaattagatatccttggcgataacgggaatttgagaaatgaagaacaggttgcaataatccaagctggaactgtgcttgccctgtgtgaaaagtggctgaagcaaatagaggggaccgaggccgccctgacccagaagatgctggacctggagaaggagaaggacctgttcagcaggcagaagggctacctggaagaggagctcgactaccggaagcaagcccttgaccaggcttacctgaaaatccaagacctggaggccacactgtacacagcgctgcagcaggagccggggcggagggccggtgaggcgctgagcgagggccagcgggaggacctgcaggctgctgtggaaaaggtgcgcaggcagatcctcaggcagagccgcgagttcgacagccagatcctgcgggagcgcatggagctgctgcagcaggcccagcagagaatccgagaactggaggacaaactggagtttcagaagcggcacctgaaagaactggaggaaaagtttttgttcctttttttgtttttctcactagcattcattctgtggccttgatgacttcagtgagccaagaactcgggttg

SEQ ID NO: 144733 - DNA, 1835 bp, Homo sapiens
  Payload ID: 8598
  Gene Symbol: JAKMIP1
  Gene Name: janus kinase and microtubule interacting protein 1
  Uniprot ID: Q96N16
  ENST ID: ENST00000410077
  CDS Start-End: 277-1662
gcattttgagtcaggagcctggactgacccgggtccctccacagcactggagggggtgggacacatcactacagggtttccttccatgaggactctgaggagttgacagtggaggcaaggagtgagctggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaagatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttatt

SEQ ID NO: 144734 - DNA, 2371 bp, Homo sapiens
  Payload ID: 8598
  Gene Symbol: JAKMIP1
  Gene Name: janus kinase and microtubule interacting protein 1
  Uniprot ID: Q96N16
  ENST ID: ENST00000409831
  CDS Start-End: 275-2155
attttgagtcaggagcctggactgacccgggtccctccacagcactggagggggtgggacacatcactacagggtttccttccatgaggactctgaggagttgacagtggaggcaaggagtgagctggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgc

SEQ ID NO: 144735 - DNA, 2420 bp, Homo sapiens
  Payload ID: 8598
  Gene Symbol: JAKMIP1
  Gene Name: janus kinase and microtubule interacting protein 1
  Uniprot ID: Q96N16
  ENST ID: ENST00000409371
  CDS Start-End: 451-2391
agctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaagatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactgaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagagagagagaggaggtcgccagcatttaacctccaaatcaccaccttccccgagaaccacagcagcgctctccagctgttctgtcaccaggaaggagttaaggatgtgaatgtttctgaacttatgaagaaattagatatccttggcgataacgggaatttgagaaatgaagaacaggttgcaataatccaagctggaactgtgcttgccctgtgtgaaaagtggctgaagcaaatagaggggaccgaggccgccctgacccagaagatgctggacctggagaaggagaaggacctgttcagcaggcagaagggctacctggaagaggagctcgactaccggaagcaagcccttgaccaggcttacctgaaaatccaagacctggaggccacactgtacacagcgctgcagcaggagccggggcggagggccggtgaggcgctgagcgagggccagcgggaggacctgcaggctgctgtggaaaaggtgcgcaggcagatcctcaggcagagccgcgagttcgacagccagatcctgcgggagcgcatggagctgctgcagcaggcccagcagagaatccgagaactggaggacaaactggagtttcagaagcggcacctgaaagaactggaggaaaagtttttgttcctttttttgtttttctcactagcattcattctgtggccttgatgacttcagtgagccaagaactcgggttg

SEQ ID NO: 144736 - DNA, 2605 bp, Homo sapiens
  Payload ID: 8598
  Gene Symbol: JAKMIP1
  Gene Name: janus kinase and microtubule interacting protein 1
  ENST ID: ENST00000473053
  CDS Start-End: 451-2160
agctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagtgacttctcgctgctgccaggcgatgggtgctgctgtttcccttcttggacagaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaa

SEQ ID NO: 144737 - DNA, 6001 bp, Homo sapiens
  Payload ID: 8599
  Gene Symbol: JAKMIP2
  Gene Name: janus kinase and microtubule interacting protein 2
  Uniprot ID: Q96AA8
  ENST ID: ENST00000265272
  CDS Start-End: 469-2901
gaggaggagccagaggaggtgtctgctgcaagttcctggctgcttccgagctcaccccatcctccgagagggaggaggcccaactggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcaggattcacactgggtagaagataaacaacttttcattaagagaaaccaggagcttttagaaaagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaagtctggtttcttactacagggatttgcttttctgtctttatgattgttttaaactcaggaacagagacatccgcatcgtaaatgggaagaaaaacactctctgttttgtttttctgcaaaaggtggagcttgtggaattcattccacagacgacagatgagaagtggatcacagtgaccacaacaaaactggtaacgaagtcaaaggacccgagcgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtagataacagaacaacctcaatttttcaaatttttgaagttttatttatggggctagaattcccatgcatagagaatatgtgtagggagccagaaactctttctatgaaatgctatacaaatctttccatatgtgggttcactatcatccttcagttttagcactggcatttgcaaagccagaacaataactgaagaatgtacaataaaaactagaatgctggggtcccactttttgttcttacatttactgctgacccaggtatctttggcccagtcacttaacctctctgtgcctcagtttcctcatctgcaaaatggggttaaaatgctttttcataaagttttatttgcaattttagaacaagaggtgcttaaagtagcacaatgtgctttgtaattattacaagtgctgtattatttgactttcttgtgttgttgacaaaaagattccctcatgtaataaaatagtgcttcagtttggttaaatttaagcactatagcactgaagcttgcttatcaagctacttgggacattattagcaataaaaattgagagattcaaaaccaggatctttaataatctataggaaatagatcatctcatgctattgaacaagatagaagagtgtgtcatttctatgataagcatctcccagctctcttgattgcatatgcatgccatcatacagaaccccacttttaccacaggagagccagtcattaaacaaaggcttggagcaaactgacagtatcacataattagcttgattatcttttattctggaggaaagccaggtggtatgccctactgggaagatacaaaacagactatcctgctgtattcttttttttttttttttttgagatggagtcttgctctgttgcccatgctggagtgcattggcacaatctcggctcatggcaagctccacctcctggattcaagtgattctcctgcctcaacctccctagtagctgggattacaggtgcacaccaccacacctggctaatttttgtatttttagtagagacagggtttcactatgctggtcaggctggtctcgaactcctgacctcaagtgatctgcctgcctcagcctcccaaagtgctaggattacaggtgtaagccactgtgcccggcctcctgctggattctttattcaactaggtaggttccagattaaatatgagccatatgctcattaggcaagaaatgtgaaagagggtgcctctacagtgttggtgacccaacactagccaacttgagtcagaaaatatggaagaggataaattactctcacatatctaagacttttccatttttcttcactttctgttgcagggcccatatgagtaaatctatattccgtctgctccaacacacaccttccttctcttaattttgctttcccacccaccaagaaatttgtaagtcaaaatttatttccatgagtaactatttctaaatgattgaaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaataga

SEQ ID NO: 144738 - DNA, 2992 bp, Homo sapiens
  Payload ID: 8599
  Gene Symbol: JAKMIP2
  Gene Name: janus kinase and microtubule interacting protein 2
  Uniprot ID: Q96AA8
  ENST ID: ENST00000333010
  CDS Start-End: 311-2647
agccagaggaggtgtctgctgcaagttcctggctgcttccgagctcaccccatcctccgagagggaggaggcccaactggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcaggattcacactgggtagaagataaacaacttttcattaagagaaaccaggagcttttagaaaagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtctt

SEQ ID NO: 144739 - DNA, 5915 bp, Homo sapiens
  Payload ID: 8599
  Gene Symbol: JAKMIP2
  Gene Name: janus kinase and microtubule interacting protein 2
  Uniprot ID: Q96AA8
  ENST ID: ENST00000507386
  CDS Start-End: 236-2635
ggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaagtctggtttcttactacagggatttgcttttctgtctttatgattgttttaaactcaggaacagagacatccgcatcgtaaatgggaagaaaaacactctctgttttgtttttctgcaaaaggtggagcttgtggaattcattccacagacgacagatgagaagtggatcacagtgaccacaacaaaactggtaacgaagtcaaaggacccgagcgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtagataacagaacaacctcaatttttcaaatttttgaagttttatttatggggctagaattcccatgcatagagaatatgtgtagggagccagaaactctttctatgaaatgctatacaaatctttccatatgtgggttcactatcatccttcagttttagcactggcatttgcaaagccagaacaataactgaagaatgtacaataaaaactagaatgctggggtcccactttttgttcttacatttactgctgacccaggtatctttggcccagtcacttaacctctctgtgcctcagtttcctcatctgcaaaatggggttaaaatgctttttcataaagttttatttgcaattttagaacaagaggtgcttaaagtagcacaatgtgctttgtaattattacaagtgctgtattatttgactttcttgtgttgttgacaaaaagattccctcatgtaataaaatagtgcttcagtttggttaaatttaagcactatagcactgaagcttgcttatcaagctacttgggacattattagcaataaaaattgagagattcaaaaccaggatctttaataatctataggaaatagatcatctcatgctattgaacaagatagaagagtgtgtcatttctatgataagcatctcccagctctcttgattgcatatgcatgccatcatacagaaccccacttttaccacaggagagccagtcattaaacaaaggcttggagcaaactgacagtatcacataattagcttgattatcttttattctggaggaaagccaggtggtatgccctactgggaagatacaaaacagactatcctgctgtattcttttttttttttttttttgagatggagtcttgctctgttgcccatgctggagtgcattggcacaatctcggctcatggcaagctccacctcctggattcaagtgattctcctgcctcaacctccctagtagctgggattacaggtgcacaccaccacacctggctaatttttgtatttttagtagagacagggtttcactatgctggtcaggctggtctcgaactcctgacctcaagtgatctgcctgcctcagcctcccaaagtgctaggattacaggtgtaagccactgtgcccggcctcctgctggattctttattcaactaggtaggttccagattaaatatgagccatatgctcattaggcaagaaatgtgaaagagggtgcctctacagtgttggtgacccaacactagccaacttgagtcagaaaatatggaagaggataaattactctcacatatctaagacttttccatttttcttcactttctgttgcagggcccatatgagtaaatctatattccgtctgctccaacacacaccttccttctcttaattttgctttcccacccaccaagaaatttgtaagtcaaaatttatttccatgagtaactatttctaaatgattgaaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaatagatacatctctctattatccattttcacaattataaaagcatcagcaaaattgtggatatgtgttccagtcactcatggatccatggaaatggaccgtgtttaaatgaatgcttcccttggatgggatgttcagcaatagc

SEQ ID NO: 144740 - DNA, 9272 bp, Homo sapiens
  Payload ID: 8599
  Gene Symbol: JAKMIP2
  Gene Name: janus kinase and microtubule interacting protein 2
  Uniprot ID: Q96AA8
  ENST ID: ENST00000616793
  CDS Start-End: 542-3004
tggcaaccagcagctgccgggccagcagcctctaccgcagcaggggtggggcactgggggagggggagagagagaggaggagccagaggaggtgtctgctgcaagttcctggctgcttccgagctcaccccatcctccgagagggaggaggcccaactggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcaggattcacactgggtagaagataaacaacttttcattaagagaaaccaggagcttttagaaaagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaagtctggtttcttactacagggatttgcttttctgtctttatgattgttttaaactcaggaacagagacatccgcatcgtaaatgggaagaaaaacactctctgttttgtttttctgcaaaaggtggagcttgtggaattcattccacagacgacagatgagaagtggatcacagtgaccacaacaaaactggtaacgaagtcaaaggacccgagcgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtagataacagaacaacctcaatttttcaaatttttgaagttttatttatggggctagaattcccatgcatagagaatatgtgtagggagccagaaactctttctatgaaatgctatacaaatctttccatatgtgggttcactatcatccttcagttttagcactggcatttgcaaagccagaacaataactgaagaatgtacaataaaaactagaatgctggggtcccactttttgttcttacatttactgctgacccaggtatctttggcccagtcacttaacctctctgtgcctcagtttcctcatctgcaaaatggggttaaaatgctttttcataaagttttatttgcaattttagaacaagaggtgcttaaagtagcacaatgtgctttgtaattattacaagtgctgtattatttgactttcttgtgttgttgacaaaaagattccctcatgtaataaaatagtgcttcagtttggttaaatttaagcactatagcactgaagcttgcttatcaagctacttgggacattattagcaataaaaattgagagattcaaaaccaggatctttaataatctataggaaatagatcatctcatgctattgaacaagatagaagagtgtgtcatttctatgataagcatctcccagctctcttgattgcatatgcatgccatcatacagaaccccacttttaccacaggagagccagtcattaaacaaaggcttggagcaaactgacagtatcacataattagcttgattatcttttattctggaggaaagccaggtggtatgccctactgggaagatacaaaacagactatcctgctgtattcttttttttttttttttttgagatggagtcttgctctgttgcccatgctggagtgcattggcacaatctcggctcatggcaagctccacctcctggattcaagtgattctcctgcctcaacctccctagtagctgggattacaggtgcacaccaccacacctggctaatttttgtatttttagtagagacagggtttcactatgctggtcaggctggtctcgaactcctgacctcaagtgatctgcctgcctcagcctcccaaagtgctaggattacaggtgtaagccactgtgcccggcctcctgctggattctttattcaactaggtaggttccagattaaatatgagccatatgctcattaggcaagaaatgtgaaagagggtgcctctacagtgttggtgacccaacactagccaacttgagtcagaaaatatggaagaggataaattactctcacatatctaagacttttccatttttcttcactttctgttgcagggcccatatgagtaaatctatattccgtctgctccaacacacaccttccttctcttaattttgctttcccacccaccaagaaatttgtaagtcaaaatttatttccatgagtaactatttctaaatgattgaaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaatagatacatctctctattatccattttcacaattataaaagcatcagcaaaattgtggatatgtgttccagtcactcatggatccatggaaatggaccgtgtttaaatgaatgcttcccttggatgggatgttcagcaatagcaaaaaaaaaaaaaaaaaagttatcaataactgagatttcctgtggccccacttctgcatctgtactaccgagatgcatttggctactgagtttgtagcagtcagaacagcattcttccgggttcattaacttaatttttctcaataaaatattcataccctggaaaataaacataactgactactaaagataatttgagataaataaaagacccaatttaaatagttattcaggatagaaaaatttcatgaaagaggggaaaaacatagagagactatctttgactatcatacttaaaaagcatctattactaaattgaatgtcaaacttttctttaatgccaccctacttttaggaaatagaatttgctgaaaaaaattacaacccttctgacttatgctatataaattaaattattaccaacagttaggttttaggggtggaagaatagatcttgatttaatttttttttttttttttggcccacaaataactgctcatacaggttgtatgtgtcttcccaagtccataaggtagagctgatatagaaggcctgggttatcacttaggtagagagcaaatgtgttctccactagtaataggagaaataaagtttgccaaataaattttgctgcagtattttgtttcaactttgctttcaattttaaataaatctctggcaaacttgttcctttttgcccattgactgtcaaattttcctgtaaacccattgtgtaattcttatgtttgctttaacataattcacaagttcattgtttcaaaatgaagcacgtctttttaacctgcctaggtttttgtagaaactgtaaaaagaatattcattggttttgtgttgatgtttaaataattggatcatctgtgttatattacatcaagatagatggacagcatagaaattttatttttaaaatatttaattgcattatttcaatctgtcaaagagtggcacagaatacacacacaaacacacacacacacacacacacacacagagcaatagaaatttgctctgtaatttgggagttgcattgcttgttgccttttgtgaaattttcataacagtgttttggtaattaatgacagcttttggcagtttaattctatcattttactaatttagatttatctattacattgaaaaaattcaatataacttttgaatgataaacattcaaagcaaatcttagatgactgtttatgtcatgagtttatgcttccaatatggacccaagcccctctttaagcagacttctaggtcttaagtgaggaaagatgtcattgtgttctactgccttgtcatttctatataatgtagtatcttgagatctaatttcaggcatattggcaagaagatacagacataatggaaagttggagctaatccctgtaaggcctcttcaagtgccaaattctattattccatttcagaatggggcagggcagattcacaatcctttgctgtcattagtttggcggtttagttcttcctaaataaatctcttgctgggagtccaagtccaatgcttaatcaaaattcctaaagatagctactcagaaggctaaggtggcaggatagcttgggcccaggagtttcataacggcctgggcaacatggtgagacctcatctcaaaaaaaaaaaaaaaaaagaaagaaagaaaagagggagagaggaaaaaaactactaaagatatacttataggggcaatgtagcaaaaataggattataatttcctatattcaaattaatgtggcagagatacacgtggttgatttggtgagggttcctgtttttgtttttttctgcattacggtctttgtacccatgcttatattttcatccttgttatatgcaaagttctgtagggtgagaatggtaaagttaaacaactttgagcccaattttgcccacaatcaagatcccacgaacttactaaagagtggatgatgcaattttccaactaaaacagatccccagcatctgttagtaacaacacttctatttgactgacatctcacagactgtgcctataccagccattaaccatagcaacttcccacaatgaggcagatcaaaatccaaacatttttataaatatgtgatgtaaatatatgcacagatatattctgtacatagtatgatggtgtgagcgcttactaaacgtgtacttctgttctaggatgcaggacttcaagaaaggttttttctgcgctgctgctgcttctgctgggaactcatgtttttgtcgagcatttagtgtttgaactcttcccatccttgactacctcttctctcccttaccccaccttctgttcactactattatttccaattgttgactgaggcagagaccactcggtttttcaattatccaggcccataaaccagcaaataggttttttttatttgtttggttggttggttgatgtttcttttttttgaaagagcaacagaaagttcagcacaatctacagtattaaaattagccaaaagtcccatatctttattagctaaaaattccatctcaacagggttcatgcatgttttagccttcaagatccaatactttggggactcaagtatagagctaatgtgtttgaatacataattccccaggtgtttactgtgttaatgtagccaagggtccaatttcacagagctttcattcaatcaactgcctcaattggggttctttctttccatctcattagcatgactccatatatcacttcagtgcttgtttattaatgaaagaaaaataaaaattgactgagtttcaccagaatgatcctctgaagtacaccgaatatgtacatgtactgtatgtattaccgtagagattggaatcaacttactgtatgtaaagttttatgaatggttattttataatttatgtatttaatataggaatcgatgaactctggtgttttagtttatataaaaataaaacaagctgcattttttaaaa

SEQ ID NO: 144741 - DNA, 6626 bp, Homo sapiens
  Payload ID: 8600
  Gene Symbol: JAKMIP3
  Gene Name: Janus kinase and microtubule interacting protein 3
  Uniprot ID: Q5VZ66
  ENST ID: ENST00000298622
  CDS Start-End: 139-2673
ggtgaatgagaagatgtagtgtgacagcagcccgggtgacacctgctgggagcttggcgtggacaccccagccacccccagcccagcccagccggagcaccctacccctgggcatccccctggccatccagcctcaccatgtccaagaggggcatgagcagccgggccaagggggacaaggcagaggccctcgcggcgctgcaggcggccaacgaggatcttcgagccaagctcacagacatccagatcgagctgcagcaggagaagagcaaggtcagcaaagtggaacgcgagaagaaccaggagctgcggcaggtgcgcgagcatgagcagcataagaccgcggtcttgctcacggagctcaagacaaagctgcacgaggagaagatgaaggagctacaggctgtgcgtgagacgctgctgcggcagcatgaggctgagctgctcagggtcatcaagatcaaggacaacgagaaccagcggctgcaggcactgctcagtgccctgcgtgatggcggccccgaaaaggtcaagaccgtgctgctgtccgaggccaaggaggaggccaagaaggggttcgaggtggagaaggtcaagatgcagcaggagatctccgagctcaagggcgccaaaaggcaggtggaggaggcgctgacgctggtgatccaagcggacaagatcaaggccgcagagatccgcagcgtgtaccacctgcaccaggaggagatcacccgcatcaagaaggagtgcgagcgggagatccgcaggctgatggaggagataaaatttaaagacagagcagtcttcgtgctggagagagagttaggggttcaagccgggcatgctcagagactgcagctccaaaaagaggctctagatgagcagctgtcccaggtccgagaggccgaccggcacccgggcagccccagacgggaacttcctcatgcagctggtgcaggagacgcttcagaccactcgggaagccctgaacagcagttggatgaaaaagatgcccggcgcttccagcttaaaatcgcggagttaagtgcgattatccgcaaactggaggaccgcaatgcattgctgtcggaagagaggaatgagctgttgaagcgcgtaagagaagctgagagtcagtacaagcctctgctggataaaaacaagcgcctcagtcggaagaacgaggatttgtctcatgctttacgccgaatggaaaacaagttaaaatttgtcacccaggagaacatagaaatgagacagagagctggaatcatacggagacccagttccttgaatgaccttgatcaaagtcaggatgagagagaagtcgatttcttgaagcttcagattgtggagcagcaaaacctcatagatgaactgtctaagacccttgagaccgccggctacgtgaagagcgtgttagagcgggacaagctgttaagattccggaagcaaagaaagaaaatggcaaaacttcccaagccggtggttgtggagaccttctttggatacgacgaagaggcttccctggaatccgacggctcctccgtctcttaccaaacagacaggacggaccagaccccgtgcaccccggacgatgacttggaggagggcatggccaaggaggagacggagctgaggttccggcagctgaccatggagtaccaggccctgcagcgtgcctacgctttgttgcaggagcaggttggagggacgctggacgcagagcgagaagttaagacccgtgagcagctacaagccgaagtgcagagggcacaggcgcggatagaggacctggagaaggccctggcggagcaggggcaggatatgaagtggattgaagagaagcaggcactgtaccggagaaatcaagagcttgtggaaaagatcaaacaaatggagacggaagaggctcggctcagacacgaggtgcaggacgccagagaccaaaacgagctgctggagttcaggatcctggagcttgaggagagggagaggaagtcacccgccatcagcttccaccacacgcccttcgtggacgggaagagccccctccaggtgtactgcgaggccgaaggtgtgacggacattgtggttgcggagctgatgaagaagctggacatcctgggcgataacgccaacctgaccaatgaggagcaggtggttgtcatacaagccaggacagtcctgaccttggccgaaaagtggctccagcagattgaggagacagaggcggcgctgcagcggaagatggtggatctggagagcgagaaggagctgttcagtaagcagaagggctacctggacgaggagctggactaccggaaacaggccttggaccaggccaacaagcacatcctggagctggaagccatgctgtatgatgccctgcagcaggaggccggggctaaggtggctgagctgctgtcagaggaggagcgcgagaagctcaaggtggccgtggagcagtggaagcgccaggtcatgagtgagctgcgcgagcgggacgcccagatcctgcgggagcgcatggagctgctgcagctggctcagcagagaattaaagagttagaagaaagaatagaagctcagaagagacaaataaaggaactggaggaaaagtttctatttttgttcttatttttctccttagctttcattctctggtcatagtccgtcttggcaccctgacgtgccccacattgaatcggacccttttcctccagtgggaccagaaagcagggacaaaatgggacgtcgcgtctccatcctgaagacccagggagatttggtctctgcacgcccgtcccgtggaggaagagtgagaaggggcagtgtgtggggcgtggagctgccgtccacgtgggatgtgccagaactagaactggctctgccgacttctcgggggcttctccgggacgggcctggccttggctgctggaccctgggtcccttctcccggacggcagcccccatcccatttccagggatgtgtagcattccctgccaagcaggggtgagaactgcttctgtgcagaagcaccagccgcgggtcccctcctctctcttggttctcacagtagctgccactggtgtctggaggaagattttcagaaacaacagaggcttggcctgatgacaagatgaaagctggacggtgaccttcattcaggggaacctggaggctccctgggatggtcctgggagggctccccgacgcctcaggggcccctccgatgctgcaatatgttgctggggtcctgagcacccgctggccaacagaccccacatccaccctcgttcatcatcatctctgtggggacagacaagagccgtggccgccgcgggccgcgtggtgccatcaaccctctgcctccctactcaacctgagacaggaaggccaagatcccgcccaagccgccagctgggagcaccgcgggactgagccaaggaaggcgtggggagcgtggtgacaggaggtgggacgagggggcggagctggctggaacacggatgccagaggctgcctccatagtgaatctccagaagtcacagaggccctgggcacccagagccacccagcctggaagcccctgcacgggccagccctgcaggccatggaccccggcgggcaccgaagcctcaccccaagcctttgcacacaaggagcagcccaggtggggatggcgggcgcaagaagggaaccgcggggacggcctttcccctcccgccctgtgtggggacgctgcacgagccgtggaccaagaggctgacaggaggggtccgcagcgaggaggaggtgcgaagggggcggcggctccgtcttgcaggtcccctggggcgcgttcttcaggtgcgtggtggacgaggcggcgtcctcgcggggtcgggacctgggtacccagcagcatctggctcctgcatccaccaagggcgcccaggcacagcctcaggccagaaggttcgctgcagaggttcattctagaaggagcgggagaccagcagtcccagccctgtccaaggacgcccgctgcttggcacacgagggcgccgcaggcccaccatccctcaggacatggctgccgagtccccagagacttctggtcccacagcaagagctggagctccaagcataacatctctaactgtgcggcaaggacagcgcagccagagagaggaagcagtgcattggtgaaggcaacgttaggtgtgatttccattcctgctgggagacccgggacgcagcccgggagcttcgtccagcctgtggatggagcctgactggctgcagatggaacttctgtgtcctcccaccctaggtgggctaaggttctgctctcagagctgaattgacaggaggtgtgtgtgtgtgctcacttgtgtgcacaagcatgcgtttatgcatgttttcacgcaaccagaagagccattcgtgggatttagccatttcgaggcacctagaagttgaggcagccagctgtgcagccaggtgtgactgttactggcagcattgtataaaagacacgactcagctgccgtagggaggactgggttgtctggaagtattaggctcattttatatttgtgtcagaagaaatgtctgactttggggcagatgacacggtggctgcggaccaggcatggctccctaggttgaaatcagggaaaagctaatagtatcagacagatatgctttttctttggtggctgcaggatttttgctggaaaatgcactattaatcagcacttgtccaagaaagacccatccatttctgttgtcattcaagccacagttcctgatttactcggcaagatactgggccagttcagtgtctctagctgagcctgacctcggggtttgcgtctcgagtctgaaatcctgtttagtcctctgtgcatagttttgtctcattttaacgactgcatcttcttggcacatttattatactcacaactgaatggcacacaatagccttgtgttaataaaagctaccgtggcgctgtgggtgaaccgctgggttgaagtccgatggactctacgatgcaggcatccagaaatatgttgtaactctacctggctccctgccagcctggcctcctcctctgggagagctcctggcatggtcccaatgtgtacctgcatgggaacaacagctgcatgggccagctgtttcggatctaaagatgtgcagtgaaactcacattcccagattcacatccctcatgtttatttgggtcatcatggtttagcatgttgtatatatgtctggagcacttcatacacctctatccaccacagacactcttaatcacagttctgtaataataataaggcaaactatacggcaaagagaagcatgtaaatatgtaccaaatccttatgaagttgtaattgtttatatgtaaaaagtatgtatataggaacgggagaaggtgcaaggaatgtgctgaataacatccaaactgcatcgcgtctctgccccattcctgaaagcacacatctagttggagcgtcagttcctctccttagatatcattgttttcactcgtctatcataggcaccttctttacatctgattacaatacccagcatttcagaactgggtttttgcccccaaaaaggtaaatatgagcatttatcactgactcctcctggtccagtgagcagcagcagaattcaagtatttaaaaataaggtgcatttctaaattgcaggctataccttcttttccaaaccaatgggctagagtgaatttcctccaagtacttgggctgtcttactgctagctcttctaacaggggaagtctgtatgaatgcatcaccccctaataaggcaagaggaaggaccctgaaatgttgccagaaatgtactgttacatcaacatttacattatattaacatcatcacactctgtgttcaacacacagaacaacatagatactttagtttgtctaaagtaaaaatccacataaatagcagattcctttgttgacaccagtgtgttgtttaccttgtgcccatggtccagattttgagctggagaaggactatggctgttccttaaagtctctgcccttgcagaatctgtagccttcaggataccccgagtgccttacagggcttgtgaacaccgatactagaagtcaaaaagaagagagtgcccaagtgtgggtttggaggcactgacgcattcgccaactcaccgtcatcccatccttgaaaccctgagagagagtgtgtgttttatcacagtaatggaattcagtttagcctcaggaaactcatattgtgaatataggtatcaaatcatatatttgtttactgtatattttttaaaaagctttattgtaaatttatgcaaaaactaaccgggcctgttttcttacggcggcatgccaggtagtgtgtgtattctcccaggcactcccttcatagtcaccctctaaccacgtgacattccgttccatgctaagcagtattcacaggcctaaaataggtttgtatggtgatctacaagattttacaaatatttttgtattgtgattcctatgatatataccagagaattttttactcgtttgtaaattattgtacagttttaataaaaaatgttttaaatctta

SEQ ID NO: 144742 - DNA, 3125 bp, Homo sapiens
  Payload ID: 8601
  Gene Symbol: JAZF1
  Gene Name: JAZF zinc finger 1
  Uniprot ID: Q86VZ6
  ENST ID: ENST00000283928
  CDS Start-End: 167-898
atctctctcgccccctctccctccgtcccgtcctcgccgctcccctcaccccgcctctctccccctcccccagcccctcctctcctcaccccacccggcctccctccctccctcgcccgcccggcgctcgcagagccgacaccaggggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaa

SEQ ID NO: 144743 - DNA, 571 bp, Homo sapiens
  Payload ID: 8601
  Gene Symbol: JAZF1
  Gene Name: JAZF zinc finger 1
  ENST ID: ENST00000430432
  CDS Start-End: 52-571
taatcagctgtaagtgccgtcactggatagaaggtccgtccttgggtctgtatgtgggtggcaaatgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaac

SEQ ID NO: 144744 - DNA, 2919 bp, Homo sapiens
  Payload ID: 8601
  Gene Symbol: JAZF1
  Gene Name: JAZF zinc finger 1
  ENST ID: ENST00000427814
  CDS Start-End: 1-692
gttactttgtgttaggtagcctcatatattctgatgcaaaatctaaaaaaaatcgtaattgtgtttttattacagatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaa

SEQ ID NO: 144745 - DNA, 503 bp, Homo sapiens
  Payload ID: 8601
  Gene Symbol: JAZF1
  Gene Name: JAZF zinc finger 1
  ENST ID: ENST00000454041
  CDS Start-End: 56-256
ctcgcccgcccggcgctcgcagagccgacaccaggggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagacagcggagatgagacagacctagagaagacctcccttctcgctgtcctacttgtccaaaagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacagg

SEQ ID NO: 144746 - DNA, 585 bp, Homo sapiens
  Payload ID: 8601
  Gene Symbol: JAZF1
  Gene Name: JAZF zinc finger 1
  ENST ID: ENST00000447620
  CDS Start-End: 41-585
aatatttataagggggattgtgcaagagtttgtgtgacagatggacattttatcactgttgatgtttggaattcccttgaaaaatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaa

SEQ ID NO: 144747 - DNA, 564 bp, Homo sapiens
  Payload ID: 8601
  Gene Symbol: JAZF1
  Gene Name: JAZF zinc finger 1
  ENST ID: ENST00000452993
  CDS Start-End: 2-244
catgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagggacattgggcatcagatggagtcaaggctgaaccgatctactgtagcatcctgagaggcccctgtgtggaaatgaaagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagct

SEQ ID NO: 144748 - DNA, 2966 bp, Homo sapiens
  Payload ID: 8602
  Gene Symbol: JMJD7-PLA2G4B
  Gene Name: JMJD7-PLA2G4B readthrough
  ENST ID: ENST00000342159
  CDS Start-End: 9-2690
acgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccaggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggca

SEQ ID NO: 144749 - DNA, 3331 bp, Homo sapiens
  Payload ID: 8602
  Gene Symbol: JMJD7-PLA2G4B
  Gene Name: JMJD7-PLA2G4B readthrough
  ENST ID: ENST00000382448
  CDS Start-End: 10-3048
gacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaa

SEQ ID NO: 144750 - DNA, 2734 bp, Homo sapiens
  Payload ID: 8602
  Gene Symbol: JMJD7-PLA2G4B
  Gene Name: JMJD7-PLA2G4B readthrough
  Uniprot ID: P0C869
  ENST ID: ENST00000458483
  CDS Start-End: 102-2447
accaattgggacatcacatccctggctctgggttagaaagctgacagtccttgatcctgtggccactgccccatcattcctgctcctgaggactcagtctcatggctgtggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaatgtg

SEQ ID NO: 144751 - DNA, 3178 bp, Homo sapiens
  Payload ID: 8602
  Gene Symbol: JMJD7-PLA2G4B
  Gene Name: JMJD7-PLA2G4B readthrough
  ENST ID: ENST00000487292
  CDS Start-End: 1-245
cctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacaccaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccagactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaa

SEQ ID NO: 144752 - DNA, 1726 bp, Homo sapiens
  Payload ID: 8603
  Gene Symbol: JKAMP
  Gene Name: JNK1/MAPK8-associated membrane protein
  Uniprot ID: Q9P055
  ENST ID: ENST00000261247
  CDS Start-End: 148-1083
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaa

SEQ ID NO: 144753 - DNA, 2524 bp, Homo sapiens
  Payload ID: 8603
  Gene Symbol: JKAMP
  Gene Name: JNK1/MAPK8-associated membrane protein
  Uniprot ID: Q9P055
  ENST ID: ENST00000356057
  CDS Start-End: 233-1192
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggatttatagcgcccgtcacaaagggcaggaccgctgcaaaaaaatggaatcttaaaactttagccatcgttcgctaaaggaaatgaaaggagaaattcaacagtcgcttggagcctgggttttgcttacatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattagatttaatgaaatacagaagatacacagaataaaaagggttttcctgtggttggtttgtggtttgtgataggtgttctgtgatgtttatgctttgaaggccttaagactcatggttgcaaccatggaagcaaaatgaaatttttagctcttaacctaacaacctgaccatgtttatccatttttattgtttagaagtttatttactgatacttggtggaggttgtgtgaattagttaaattttaaatgtttaagacttctattaacagctgcaaaatatgaaagtaagtgcactcacttttcctgtagtagtctgtcttttgaattcacagcagttgtatccttgagttactttgttaatgtatttttctcagtacatttaaccactgggaaatgaacccttgtacgaatgtgtttcttcttctctgtaggaataaaaaataaatataaaaattttatttgtattgcacacatttggggggttattagtgttcattaaaattctgagttgccc

SEQ ID NO: 144754 - DNA, 1636 bp, Homo sapiens
  Payload ID: 8603
  Gene Symbol: JKAMP
  Gene Name: JNK1/MAPK8-associated membrane protein
  Uniprot ID: Q9P055
  ENST ID: ENST00000425728
  CDS Start-End: 88-1005
ccgccgagctcgctgtggcccggatgttcggtgcagctgccagatccgctgatctagtgcttctcgaaaaaaaccttcaggcggcccatggcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctac

SEQ ID NO: 144755 - DNA, 2137 bp, Homo sapiens
  Payload ID: 8603
  Gene Symbol: JKAMP
  Gene Name: JNK1/MAPK8-associated membrane protein
  ENST ID: ENST00000554271
  CDS Start-End: 527-1504
gatccgctgatctagtgcttctcgaaaaaaaccttcaggcggcccatgggtgagtggtcgccaagatcccgggaagcgtttctggtagtcccgactactttcctacacggctggcctcgggctcggctctttgtaggcggccttcggttggcggcgcaggctcgccccttgaccccgcccgccctcgggccgggctccgcactcctgcggggttggggtggtctgtccgcaacgggctactaggggaggcgcgctgtctgcggcgaaatgccaggtctttgttgtttggtccgaaatgtctcttcagtcccttagtttaatgtcgagggaacacttgcttgagggttgacttcggaattgaaaacgcgggtgatagtgcagaaaaaacagtaaagcagaagcaagttgctgcataatttgtctactgcttcaacctcaaacgtagatttatagcgcccgtcacaaagggcaggaccgctgcaaaaaaatggaatcttaaaactttagccatcgttcgctaaaggaaatgaaaggagaaattcaacagtcgcttggagcctgggttttgcttactgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacat

SEQ ID NO: 144756 - DNA, 856 bp, Homo sapiens
  Payload ID: 8603
  Gene Symbol: JKAMP
  Gene Name: JNK1/MAPK8-associated membrane protein
  ENST ID: ENST00000554795
  CDS Start-End: 116-856
tgcttctcgaaaaaaaccttcaggcggcccatggatttatagcgcccgtcacaaagggcaggaccgctgcaaaaaaatggaatcttaaaactttagccatcgttcgctaaaggaaatgaaaggagaaattcaacagtcgcttggagcctgggttttgcttacatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagag

SEQ ID NO: 144757 - DNA, 592 bp, Homo sapiens
  Payload ID: 8603
  Gene Symbol: JKAMP
  Gene Name: JNK1/MAPK8-associated membrane protein
  ENST ID: ENST00000556985
  CDS Start-End: 54-515
agctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactgtaagtgtttatttcgacttaagatcattgtttttttttaaatctctgaggattattatagattttatggcgtttggagac

SEQ ID NO: 144758 - DNA, 619 bp, Homo sapiens
  Payload ID: 8603
  Gene Symbol: JKAMP
  Gene Name: JNK1/MAPK8-associated membrane protein
  ENST ID: ENST00000555491
  CDS Start-End: 60-482
cggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtaca

SEQ ID NO: 144759 - DNA, 2338 bp, Homo sapiens
  Payload ID: 8603
  Gene Symbol: JKAMP
  Gene Name: JNK1/MAPK8-associated membrane protein
  ENST ID: ENST00000616435
  CDS Start-End: 148-786
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttataactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatttcaatgttttgacacttaattgttgtttggcacaatagtatggaagtaattcaaactggtaaatagtttcctctcatatctcgggtatatatacataccatattttattgatccagagatacttatttcactttgtgacatctctgaattaggatgcatcttacaactgatggcttattagatttaatgaaatacagaagatacacagaataaaaagggttttcctgtggttggtttgtggtttgtgataggtgttctgtgatgtttatgctttgaaggccttaagactcatggttgcaaccatggaagcaaaatgaaatttttagctcttaacctaacaacctgaccatgtttatccatttttattgtttagaagtttatttactgatacttggtggaggttgtgtgaattagttaaattttaaatgtttaagacttctattaacagctgcaaaatatgaaagtaagtgcactcacttttcctgtagtagtctgtcttttgaattcacagcagttgtatccttgagttactttgttaatgtatttttctcagtacatttaaccactgggaaatgaacccttgtacgaatgtgtttcttcttctctgtaggaataaaaaataaatataaaaattttatttgtattgcacacatttggggggttattagtgttcattaaaattctgagttgccc

SEQ ID NO: 144760 - DNA, 1438 bp, Homo sapiens
  Payload ID: 8604
  Gene Symbol: JCHAIN
  Gene Name: joining chain of multimeric IgA and IgM
  Uniprot ID: P01591
  ENST ID: ENST00000254801
  CDS Start-End: 171-650
agcatttaaacttcagacttcaaccacagttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggcttttttttttttttgggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggactgaaaatcaggaggtgtaataaaatgttcctcgcattcccccccgcttttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcata

SEQ ID NO: 144761 - DNA, 275 bp, Homo sapiens
  Payload ID: 8604
  Gene Symbol: JCHAIN
  Gene Name: joining chain of multimeric IgA and IgM
  ENST ID: ENST00000470866
  CDS Start-End: 65-275
gacttggaagtaaaatatagagcttctactgaaatatttgtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggaga

SEQ ID NO: 144762 - DNA, 508 bp, Homo sapiens
  Payload ID: 8604
  Gene Symbol: JCHAIN
  Gene Name: joining chain of multimeric IgA and IgM
  ENST ID: ENST00000391614
  CDS Start-End: 37-508
tttttgctccagtttttcagaagaagtgaagtcaagatgaagaaccatttgcttttctggggagtcctggcggtttttattaaggctgttcatgtgaaaggttcaagagattcttctgcctcagcctcccgagtagctgggattacagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtg

SEQ ID NO: 144763 - DNA, 640 bp, Homo sapiens
  Payload ID: 8604
  Gene Symbol: JCHAIN
  Gene Name: joining chain of multimeric IgA and IgM
  Uniprot ID: P01591
  ENST ID: ENST00000510437
  CDS Start-End: 152-631
gggaccttaaaggactttcatttctctccccttccttcatctctcctccttcacttaccttcatttattattctaggcatgacaagtgtcagatgtctgatttgaagactaatatgaatatatctagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtca

SEQ ID NO: 144764 - DNA, 533 bp, Homo sapiens
  Payload ID: 8604
  Gene Symbol: JCHAIN
  Gene Name: joining chain of multimeric IgA and IgM
  ENST ID: ENST00000510614
  CDS Start-End: 61-533
gatgtctgatttgaagactaatatgaatatatctagtttttcagaagaagtgaagtcaagatgaagaaccatttgcttttctggggagtcctggcggtttttattaaggctgttcatgtgaaagaaaatggaatacattctgaatttagagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaac

SEQ ID NO: 144765 - DNA, 1406 bp, Homo sapiens
  Payload ID: 8604
  Gene Symbol: JCHAIN
  Gene Name: joining chain of multimeric IgA and IgM
  Uniprot ID: P01591
  ENST ID: ENST00000543780
  CDS Start-End: 142-621
ttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggcttttttttttttttgggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggactgaaaatcaggaggtgtaataaaatgttcctcgcattcccccccgcttttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagc

SEQ ID NO: 144766 - DNA, 3648 bp, Homo sapiens
  Payload ID: 8605
  Gene Symbol: JOSD1
  Gene Name: Josephin domain containing 1
  Uniprot ID: Q15040
  ENST ID: ENST00000216039
  CDS Start-End: 681-1289
acttcccgcgcccgctcgccgctgaccggagttgtctcctcctccgcagggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccatatatgtctccttgtctgcctgaattctataattgtgtaaagaaaaataaactttagtatgacgctgttttaaaagga

SEQ ID NO: 144767 - DNA, 623 bp, Homo sapiens
  Payload ID: 8605
  Gene Symbol: JOSD1
  Gene Name: Josephin domain containing 1
  ENST ID: ENST00000417712
  CDS Start-End: 437-623
acttgaaatgtgactcccagcgagacacctacccttgacgctccctggacagtgcggcacggtcgggcccactaaccaaggcaatttgcgcccgaccgaatcaggtgcttcaaaatcccccctggtgagccgcgcgttaaccacacataaaacagtcaacgcagaaggagcgagaacgttcggccgaaaagcccggcacagagaagggaggggtgctgaaagccgcggactgcagccgctggcctggctgccgccccgaaacaacgcccacgcccgggagaagggcaggctggcgtccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggt

SEQ ID NO: 144768 - DNA, 843 bp, Homo sapiens
  Payload ID: 8605
  Gene Symbol: JOSD1
  Gene Name: Josephin domain containing 1
  ENST ID: ENST00000456626
  CDS Start-End: 659-843
gcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagag

SEQ ID NO: 144769 - DNA, 571 bp, Homo sapiens
  Payload ID: 8605
  Gene Symbol: JOSD1
  Gene Name: Josephin domain containing 1
  ENST ID: ENST00000427389
  CDS Start-End: 202-571
gaggacggcgcgggagggcgtttccggagcacgcgccgggcgggggccgctgacgtcgggctcagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccct

SEQ ID NO: 144770 - DNA, 529 bp, Homo sapiens
  Payload ID: 8605
  Gene Symbol: JOSD1
  Gene Name: Josephin domain containing 1
  ENST ID: ENST00000412832
  CDS Start-End: 216-529
agttggcggcgcgcactccaggtggcggccggctgcggtgaggggaccgccagcggcgagcagtcccggcggccctgggtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcag

SEQ ID NO: 144771 - DNA, 647 bp, Homo sapiens
  Payload ID: 8605
  Gene Symbol: JOSD1
  Gene Name: Josephin domain containing 1
  ENST ID: ENST00000545590
  CDS Start-End: 1-463
gaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcct

SEQ ID NO: 144772 - DNA, 733 bp, Homo sapiens
  Payload ID: 8606
  Gene Symbol: JOSD2
  Gene Name: Josephin domain containing 2
  Uniprot ID: Q8TAC2
  ENST ID: ENST00000595669
  CDS Start-End: 122-562
cccagtcagcgcggtgttgcccgccccgcactcggagcccagagccgccgcccaggaaggggatgcggaaacccctggctcggtggagcggagaggcaggcgggcaggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgc

SEQ ID NO: 144773 - DNA, 996 bp, Homo sapiens
  Payload ID: 8606
  Gene Symbol: JOSD2
  Gene Name: Josephin domain containing 2
  Uniprot ID: Q8TAC2
  ENST ID: ENST00000598418
  CDS Start-End: 255-821
ttcctaggcccgacggccgacttcagggccacgcggcccgggcgttccgtgtggagcaggagtcccgcggggccccacgggagtcgtagtccggcgcgcggggatcaccgggagctgtagtccgtcccgcctgcccagtcagcgcggtgttgcccgccccgcactcggagcccagagccgccgcccaggaaggggatgcggaaacccctggctcggtggagcggagaggcaggcgggcaggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggttggccccagactcccggctgaaccctcatcgcagcctcctgggcaccggcaactatgatgtcaatgtgatcatggccgctctgcaggggctgggcctggccgccgtgtggtgggacaggaggaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgctgcc

SEQ ID NO: 144774 - DNA, 582 bp, Homo sapiens
  Payload ID: 8606
  Gene Symbol: JOSD2
  Gene Name: Josephin domain containing 2
  ENST ID: ENST00000594350
  CDS Start-End: 100-582
gatgcggaaacccctggctcggtggagcggagaggcaggcggggtgaggggcgttgccaggcaaagggcgagcgccgtggctggggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggttggccccagactcccggctgaaccctcatcgcagcctcctgggcaccggcaactatgatgtcaatgtgatcatggccgctctgcaggggctgggcctggccgccgtgtggtgggacaggaggaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggct

SEQ ID NO: 144775 - DNA, 802 bp, Homo sapiens
  Payload ID: 8606
  Gene Symbol: JOSD2
  Gene Name: Josephin domain containing 2
  Uniprot ID: Q8TAC2
  ENST ID: ENST00000601423
  CDS Start-End: 61-627
ggggatgcggaaacccctggctcggtggagcggagaggcaggcggggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggttggccccagactcccggctgaaccctcatcgcagcctcctgggcaccggcaactatgatgtcaatgtgatcatggccgctctgcaggggctgggcctggccgccgtgtggtgggacaggaggaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgctgcc

SEQ ID NO: 144776 - DNA, 2687 bp, Homo sapiens
  Payload ID: 8607
  Gene Symbol: JRK
  Gene Name: Jrk helix-turn-helix protein
  ENST ID: ENST00000571961
  CDS Start-End: 526-2196
ggactggaggagaaccgagtggccggcacttccggccggcggcggctgctccgggtgagcaggcccctgaagtgctgtgcctggagataccattgtggaccctggagaggcacctgctgcttatgcggtaaaacctctaccaccccaaacctggtcagtttgaggggagccgctgccatagtatccacagagaaggccggagttccagccgtgtggagcagcagaggggagtctgacagggtcacctcctccacagagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctccgactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaacgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcagaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatctccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaaaaaggaaataaaatagaaaattgccatctgc

SEQ ID NO: 144777 - DNA, 9124 bp, Homo sapiens
  Payload ID: 8607
  Gene Symbol: JRK
  Gene Name: Jrk helix-turn-helix protein
  ENST ID: ENST00000612905
  CDS Start-End: 526-2232
ggactggaggagaaccgagtggccggcacttccggccggcggcggctgctccgggtgagcaggcccctgaagtgctgtgcctggagataccattgtggaccctggagaggcacctgctgcttatgcggtaaaacctctaccaccccaaacctggtcagtttgaggggagccgctgccatagtatccacagagaaggccggagttccagccgtgtggagcagcagaggggagtctgacagggtcacctcctccacagagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctccgactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaacgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcagaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcccttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatcatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtcagactgtagctcttcaggacctgagctcttcccgttcttgatctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctacgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggactgcccctgacgtcgcaggccactgttcttatccagtgggccaagtgattgattgctagtggtggagttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagcgacaacttgggacaaatcaagacccgtccacactgcacctcagggacctcacctcacgccccacataaatgtgcttattggggatccgggtgtggtggcttctgcctgaaatcccagtactctggaaggccacggcaggaggatcactttagttcaggagtttgaaaccagcctgggcaacatagggagaccccatctctacagaaagtaaaagaaaatgagccaggtgtggtggcatgtgcctgtaaccccagctactcaggaggccgaggcgggaggatccccaagcccaggagtttgaggctgcagtgagttatggcctctgcactccagcctgggtgacagagtgagagacctaatctctaaaaacaaaaaataacaaaatgtgctttggggtcaggtgtggagatcagggtcggggaggtcatgaggtaggtaggggtcaggatgtggacagtcatgggctggtgggtgtggcagccgtgaggggtgggtggtggcctgggaggcagggcctgggcagggcttctgcacttctgctgcttacccagccccctctgggttcgaggactctccttgacaagggctgagctctcgggcactgcgttggactcagctgcctactgggaggctggggagaatggacctgtgagaccttgtttgtcctcttccctgcccagctcttgtagaccccaggcctggctgtccgcagggccaggagctgcagccatggcagccaccagcctcccacatgagccccagctcccagccccacacgcccactcctttgcccatgtggtgtcagctctggcctctgcttctacacatggaccctcagaccttgcacatctgttgtttcccttgcagggcagtgatgatgacatgaaatgaggtggggtcactcctgtttagggatgagactggggcccagggaggggcaggtgtgaagttgctgagggcagagggagacccagggctacctgctcctaatgaccagcctcacgttctccactgctcactccctgctgttcaccagctgcatgaccttgagcagtgcactcaactgtaaacagaggtgaaaacactcctttaccaactgttttaggggccactcttgtttgaggccttgaacctcctttcagttccgtggtggtcctgagcctctgaatctgggtatggcccctgctgggtcctggtctcttaggcagcacgatggcctccctgctcaaggccctgcacccaggggcagattgtgggaggcccactggccatggctgggccctatcgcagagagcctgtcagcacggccatttccacacccaggctggctgggaagcaagctacgaggtgctcaaaggccctctatgtctgcaggtagccccgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcctctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatctccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaaaaaggaaataaaatagaaaattgccatctgcaaatgagaaagccttcagccgacaccagactgccagtgcctttgatattggactttcagtccccagatctgtgaaaaattaatttatgttgtttaagacacctagcctgtggtattttgttatcgcaatcaaaactgactgagacaggcagtaaggagagaacagaggttccagcctgcttcaggtccaggcagttctgccattgcccctaactcctcagtgccagtcatgggccaggcccctgggggacttggaatgagtaaaacatgcacctattgttaaggttcacctggtccagaaggggaggcagacccacctgcccaccatgacccggacagaggcaataaatacggagcacctcatggccagggcctggaggattcccaccataccctacccagcgccaataacagagggaccctggagttgtgtacgcaagatagcagttcagtgcttgcacacatactagttgagaagggaaatcagggctaatgaaacagctcaactgtctggcagagccaggctccttctgccatgatacagtttggatgtttgtccctttctaatcttatatggaaatttgatccccagtgttgaaggtggggcctggtgggaaatgttcctgttatcgggatggatccttcatgaatagcctggtgccatctttgtggtaacaagtgagttctcacttgattagtttctgtgagaactgtttgttaaaaagagcctggtggcacctccctcccttcttcctcctgctcttgctatgtgatgctgctgccctttgccttccgtcatgagtggaagctccctgaagcccccaccagaagcaaatgctggcaccatgctgcttgtacagcctgcagaactgtgagccaaataaacctcttttctttataaatta

SEQ ID NO: 144778 - DNA, 587 bp, Homo sapiens
  Payload ID: 8607
  Gene Symbol: JRK
  Gene Name: Jrk helix-turn-helix protein
  ENST ID: ENST00000503272
  CDS Start-End: 511-587
gaggagaaccgagtggccggcacttccggccggcggcggctgctccggcccctgaagtgctgtgcctggagataccattgtggaccctggagaggcacctgctgcttatgcggtaaaacctctaccaccccaaacctggtcagtttgaggggagccgctgccatagtatccacagagaaggccggagttccagccgtgtggagcagcagaggggagtctgacagggtcacctcctccacagagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagat

SEQ ID NO: 144779 - DNA, 2823 bp, Homo sapiens
  Payload ID: 8607
  Gene Symbol: JRK
  Gene Name: Jrk helix-turn-helix protein
  ENST ID: ENST00000615982
  CDS Start-End: 502-2172
ggcacttccggccggcggcggctgctccgggtgagcaggcccctgaagtgctgtgcctggagataccattgtggaccctggagaggcacctgctgcttatgcggtaaaacctctaccaccccaaacctggtcagtttgaggggagccgctgccatagtatccacagagaaggccggagttccagccgtgtggagcagcagaggggagtctgacagggtcacctcctccacagagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctccgactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaacgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcagaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggagactgtgggccttgaggatgtggtagtgacctcaccagaggagttggcaattcctaagtgctgcctggaggcctctacagagacataatgttggagaacttctgccacatggcagtgctgggttcacctggtccagaaggggaggcagacccacctgcccaccatgacccggacagaggcaataaatacggagcacctcatggccagggcctggaggattcccaccataccctacccagcgccaataacagagggaccctggagttgtgtacgcaagatagcagttcagtgcttgcacacatactagttgagaagggaaatcagggctaatgaaacagctcaactgtctggcagagccaggctccttctgccatgatacagtttggatgtttgtccctttctaatcttatatggaaatttgatccccagtgttgaaggtggggcctggtgggaaatgttcctgttatcgggatggatccttcatgaatagcctggtgccatctttgtggtaacaagtgagttctcacttgattagtttctgtgagaactgtttgttaaaaagagcctggtggcacctccctcccttcttcctcctgctcttgctatgtgatgctgctgccctttgccttccgtcatgagtggaagctccctgaagcccccaccagaagcaaatgctggcaccatgctgcttgtacagcctgcagaactgtgagccaaataaacctcttttctttataaa

SEQ ID NO: 144780 - DNA, 8932 bp, Homo sapiens
  Payload ID: 8607
  Gene Symbol: JRK
  Gene Name: Jrk helix-turn-helix protein
  ENST ID: ENST00000614134
  CDS Start-End: 334-2040
cccctgaagtgctgtgcctggagataccattgtggaccctggagaggcacctgctgcttatgcgagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctccgactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaacgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcagaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcccttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatcatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtcagactgtagctcttcaggacctgagctcttcccgttcttgatctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctacgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggactgcccctgacgtcgcaggccactgttcttatccagtgggccaagtgattgattgctagtggtggagttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagcgacaacttgggacaaatcaagacccgtccacactgcacctcagggacctcacctcacgccccacataaatgtgcttattggggatccgggtgtggtggcttctgcctgaaatcccagtactctggaaggccacggcaggaggatcactttagttcaggagtttgaaaccagcctgggcaacatagggagaccccatctctacagaaagtaaaagaaaatgagccaggtgtggtggcatgtgcctgtaaccccagctactcaggaggccgaggcgggaggatccccaagcccaggagtttgaggctgcagtgagttatggcctctgcactccagcctgggtgacagagtgagagacctaatctctaaaaacaaaaaataacaaaatgtgctttggggtcaggtgtggagatcagggtcggggaggtcatgaggtaggtaggggtcaggatgtggacagtcatgggctggtgggtgtggcagccgtgaggggtgggtggtggcctgggaggcagggcctgggcagggcttctgcacttctgctgcttacccagccccctctgggttcgaggactctccttgacaagggctgagctctcgggcactgcgttggactcagctgcctactgggaggctggggagaatggacctgtgagaccttgtttgtcctcttccctgcccagctcttgtagaccccaggcctggctgtccgcagggccaggagctgcagccatggcagccaccagcctcccacatgagccccagctcccagccccacacgcccactcctttgcccatgtggtgtcagctctggcctctgcttctacacatggaccctcagaccttgcacatctgttgtttcccttgcagggcagtgatgatgacatgaaatgaggtggggtcactcctgtttagggatgagactggggcccagggaggggcaggtgtgaagttgctgagggcagagggagacccagggctacctgctcctaatgaccagcctcacgttctccactgctcactccctgctgttcaccagctgcatgaccttgagcagtgcactcaactgtaaacagaggtgaaaacactcctttaccaactgttttaggggccactcttgtttgaggccttgaacctcctttcagttccgtggtggtcctgagcctctgaatctgggtatggcccctgctgggtcctggtctcttaggcagcacgatggcctccctgctcaaggccctgcacccaggggcagattgtgggaggcccactggccatggctgggccctatcgcagagagcctgtcagcacggccatttccacacccaggctggctgggaagcaagctacgaggtgctcaaaggccctctatgtctgcaggtagccccgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcctctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatctccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaaaaaggaaataaaatagaaaattgccatctgcaaatgagaaagccttcagccgacaccagactgccagtgcctttgatattggactttcagtccccagatctgtgaaaaattaatttatgttgtttaagacacctagcctgtggtattttgttatcgcaatcaaaactgactgagacaggcagtaaggagagaacagaggttccagcctgcttcaggtccaggcagttctgccattgcccctaactcctcagtgccagtcatgggccaggcccctgggggacttggaatgagtaaaacatgcacctattgttaaggttcacctggtccagaaggggaggcagacccacctgcccaccatgacccggacagaggcaataaatacggagcacctcatggccagggcctggaggattcccaccataccctacccagcgccaataacagagggaccctggagttgtgtacgcaagatagcagttcagtgcttgcacacatactagttgagaagggaaatcagggctaatgaaacagctcaactgtctggcagagccaggctccttctgccatgatacagtttggatgtttgtccctttctaatcttatatggaaatttgatccccagtgttgaaggtggggcctggtgggaaatgttcctgttatcgggatggatccttcatgaatagcctggtgccatctttgtggtaacaagtgagttctcacttgattagtttctgtgagaactgtttgttaaaaagagcctggtggcacctccctcccttcttcctcctgctcttgctatgtgatgctgctgccctttgccttccgtcatgagtggaagctccctgaagcccccaccagaagcaaatgctggcaccatgctgcttgtacagcctgcagaactgtgagccaaataaacctcttttctttataaatta

SEQ ID NO: 144781 - DNA, 2855 bp, Homo sapiens
  Payload ID: 8608
  Gene Symbol: JRKL
  Gene Name: JRK-like
  Uniprot ID: Q9Y4A0
  ENST ID: ENST00000332349
  CDS Start-End: 248-1822
atcttccgggagcgtggctaggggcggagcgactgccgcgcgatagtcagggagctgtgcgggtcctggttgcaagagagtctatttgccagccaaccccagcccgggaggggatcagggccaccaggttgctggtaaggatgaaagactgagtgtgttaagactgttgaagtgagcctgtgtaagagaaggaaggattttgtggattgctacattgtgagtgtggggtgagtcccagaacctcgctatgtcagggaaacggaagcgtgtggtgttgactattaaagataagcttgatataataaagaaacttgaagacggaggttcttccaaacaactggcagtgatttatggaattggtgaaacaacagttcgggatataagaaaaaataaggaaaagattataacttatgcaagcagttctgattccacaagtcttttggccaagaggaaatctatgaagccatccatgtatgaggaattggacagggcaatgctggaatggttcaaccagcaaagagcaaaagggaatcccatatctggaccaatttgtgcaaaaagggcagagttcttcttttatgctttgggaatggatggtgattttaacccctctgccggttggctaactcgttttaagcagcggcacagcattagagagattaacattagaaatgaaagattaaatggagatgagactgcggtggaagatttttgtaataactttcgagattttattgaacgagagaatttacagcctgaacaaatctacaatgcagatgaaactggactcttttggaagtgcttgccttctaggatttcagtaatcaaaggtaaatgcactgtccctgggcacaaatcaattgaagaaagagtcacaatcatgtgttgtgccaatgcaacaggtttacacaaacttaaactttgtgttgtggggaaagcaaagaaacctcgctcctttaaatcaactgacaccttaaacctgccagtctcttatttcagccaaaaaggtgcatggatggatctttccattttccgacaatggtttgataaaatttttgtgccgcaagttcgagagtatttaagatctaaaggcttgcaggaaaaggctgtgctcttgttggataattcaccaacacatccaaatgaaaatgtcctaaggtcagatgatggccaaatatttgctaaatatttaccacctaatgtggcctcattgattcagccttcagatcagggagtcatagcaacgatgaagagaaattatcgtgcaggtcttctccagaacaacttggaagaaggtaatgacctgaaatcattctggaagaagctaactctgttggatgcactttatgaaatagcaatggcatggaacttagtaaaaccagttaccattagcagagcatggaagaagattctccctatggtagaggagaaagagagcctggactttgatgttgaagatatttctgtggctactgtggctgccattttacaacacaccaaaggattggaaaatgtgactactgagaaccttgaaaaatggcttgaagtagacagtactgaaccaggctatgaagtgttaactgatagcgaaatcatcagaagagcacaaggccaggcagatgaatccagtgaaaatgaggaggaggaaatagaactaattccagagaaacatattaatcatgcagctgccctccagtggactgaaaatttattggattatctagaacaacaaggtgatatgattctacctgatagactggtaatacgtaaacttcgagccaccatcagaaataaacagaagatgacaaagtcaagtcaataatgtcatttcaattttattgttctgctcattgtgtttgtgacaaactctttgcaatatggcttaattttctttgtgttctgaattctcagacttggtcctgtgaaatacaggcacaaaatgtatctgaagtggtttgaggattatgtgttttcatcatctgtgtcttttgtccttttatttgtacagataatcagaagatgatactgaatagatataaattacatgtacacatgtattcactttttagaatctgcaattataccttctgtaacagtggcattcccttaattttctagtgaaagttagagataactgaacagactgaagcacttttctgaaatcttttgcttgatttatgaaggctgccatagttatcttttcttgtgttaaccatcttaaatgatgttttgtatattttaatagactgataggatgagaaagatttatattattagatttcaggatgatttataataattcaaaaatgaaattcaataatggggaaataattatgaattatagaaattatgccttcattctcttacatttgtgtgggttgcaagagggggagattattctggaaatgaagtaaatatgggaagttattgccaaatgagagagaaactatgggaaagctgatctataaagaggcattctgatcaattcatttgtaggaaactgggaaataaaaacctggggaactttaggttatttatacaaagggaataaataggctgattttaatttggtaagttgatctttttattatgaatttggtaatagtataggtttattatttattcatctaattttatagtacaggttttgtaatgttacatgtgatgatatgagctcccaccttatatgggggaacatcttgggaatttgagatttaataagtttttttttttttttttttagtgtttttactgcatactcacaaatgttgtctataatttgaaaaatattgtcatatctggccctttgatgagaaaaggaaattacaataataaagttttatgattttaaataa

SEQ ID NO: 144782 - DNA, 3781 bp, Homo sapiens
  Payload ID: 8609
  Gene Symbol: JMJD1C
  Gene Name: jumonji domain containing 1C
  ENST ID: ENST00000327520
  CDS Start-End: 1-2870
ctgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaataccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaaggtataagttagtttgcaaataatatctcttcccctcaagcaaggacttattcattgttgccgtaccttcacttggcattcaacaatataagaccattacataatttttacttcaaagtagatgggagtttttgttgaaagtcaaaaccctgtttctcttgctcctctttgaaagtctgttaacattttgagggttttgaatggtgatttgttcccagttggtagtgtgcctccattccctgttaataaaagactgatctgttcttgagccagatattagttgggtggcgaaaagtagctatctggagtcgcgggatgtaaaaacaaatatttcatggaaacgtctaaagaaggtaggatctttattttctttgaatctgatagatatttttggctgctgacctagggaatgattctactctatcacatctgatactatgatacttactgagtagactcagattttgagtaatcataccttgactgtagttggcatatactctgaaagaaatttatatatcaacctgaaataattggttgaaaccctttgctcaggtactttttaaacttcgtaattatggaaatttgttttaagaaatgttcagtgctgatacatcatctttctgaaaggatgtaagttctgtctgtgatcaatgtgaagtaaaagagttacagccttttttgtaccattttatccctgaatacttacctgtattttaatctgaagtatgatcatttgtgccttctaaagcagattatttaactgattaaagagtcccttgaaattgatttttcaagtgttagaaggttagccatgtaaaggtatttatacttacctcaaaaaaggatcaataaatgtttatgaaatccatacatatgaatggtttggcttttggtaaaaaaaaaaaaaaaaaaaaa

SEQ ID NO: 144783 - DNA, 8666 bp, Homo sapiens
  Payload ID: 8609
  Gene Symbol: JMJD1C
  Gene Name: jumonji domain containing 1C
  Uniprot ID: Q15652
  ENST ID: ENST00000399262
  CDS Start-End: 220-7842
cacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattgactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccacccacgactagagagtgctcatgccagcagcttgagccacttagcgctagcacaccagcaacaacaacagttgttacagcaccagtcacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaattga

SEQ ID NO: 144784 - DNA, 8149 bp, Homo sapiens
  Payload ID: 8609
  Gene Symbol: JMJD1C
  Gene Name: jumonji domain containing 1C
  Uniprot ID: Q15652
  ENST ID: ENST00000542921
  CDS Start-End: 618-7694
cctgacccagatcggaggatgcagtagtgcttcagctgcaggatttcttagtcgttaacaccacagtgctgatgacaaagagcgagttgtaatcctcatcactgccagggctgagccagagcagacagaaaatcgtcatttgctcgttggagacttgttaggttacagctcctgcttcgttctgtggtcttggcttttcttcctatacaatgacgccgctgcaagtgagctcagaaatgcttggtttgagagccatttgcctgtgatttttgaagactaaagaagtatttacactagatactcttccagaacaaaatagaaatttcagcaaatacttactgacctttaaagccttgttgtggatttctgagatttaaagatactttaaaattctcaagaacaaaactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccacccacgactagagagtgctcatgccagcagcttgagccacttagcgctagcacaccagcaacaacaacagttgttacagcaccagtcacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcac

SEQ ID NO: 144785 - DNA, 2595 bp, Homo sapiens
  Payload ID: 8610
  Gene Symbol: JMJD4
  Gene Name: jumonji domain containing 4
  Uniprot ID: Q9H9V9
  ENST ID: ENST00000366758
  CDS Start-End: 1-1392
atgcgtgcaggcccggagccccaggcgctggcggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaaca

SEQ ID NO: 144786 - DNA, 2502 bp, Homo sapiens
  Payload ID: 8610
  Gene Symbol: JMJD4
  Gene Name: jumonji domain containing 4
  Uniprot ID: Q9H9V9
  ENST ID: ENST00000438896
  CDS Start-End: 1-1344
atgcgtgcaggcccggagccccaggcgctggcggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagt

SEQ ID NO: 144787 - DNA, 2432 bp, Homo sapiens
  Payload ID: 8610
  Gene Symbol: JMJD4
  Gene Name: jumonji domain containing 4
  ENST ID: ENST00000620518
  CDS Start-End: 11-1264
gctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttca

SEQ ID NO: 144788 - DNA, 2591 bp, Homo sapiens
  Payload ID: 8610
  Gene Symbol: JMJD4
  Gene Name: jumonji domain containing 4
  Uniprot ID: Q9H9V9
  ENST ID: ENST00000615711
  CDS Start-End: 1-1392
atgcgtgcaggcccggagccccaggcgctggcggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagcc

SEQ ID NO: 144789 - DNA, 1893 bp, Homo sapiens
  Payload ID: 8611
  Gene Symbol: JMJD6
  Gene Name: jumonji domain containing 6
  ENST ID: ENST00000303996
  CDS Start-End: 310-1317
cgcagccgacgtgaccttcccaacatggcggaggcccgccgtatgtgaaggagtaccccaggggagccaaagccaatggaaaaccgcgagaggcgtcggggcggggaagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagatacagcacgggcagcggcagtgcaagccacccacagccaccccgtgccactgtgtcccaaccctgacctggagggaccagctctcggggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttctatcttg

SEQ ID NO: 144790 - DNA, 1603 bp, Homo sapiens
  Payload ID: 8611
  Gene Symbol: JMJD6
  Gene Name: jumonji domain containing 6
  Uniprot ID: Q6NYC1
  ENST ID: ENST00000397625
  CDS Start-End: 116-1327
agcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttc

SEQ ID NO: 144791 - DNA, 5303 bp, Homo sapiens
  Payload ID: 8611
  Gene Symbol: JMJD6
  Gene Name: jumonji domain containing 6
  Uniprot ID: Q6NYC1
  ENST ID: ENST00000445478
  CDS Start-End: 205-1449
gaagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggattagggacacttgtggaggccgggctcacccctgagcagataaagagactctccctgaggtgctttcagcgtaagcttttggcagccacccaactcagttctcgcatcttctgctcctaccttctcctctgtcttctttgaatttggatattccttccctggtccaagctcctatcttcggtcaaatgctgtttttactgcttcctaaggatagattatcaagaaatttaacagctcggccagctcagtgaaacactgaagctaatgggatgttgggtaagaaggttctgtgctgtctcattgaaaaccgagccagtcaaccacaaggctggcagggtgtgatccttgtaacgtcttgtgtctgttacctcacggatgtcggtaaggagtttccacagagccagctgtgtaccacagagactgagagtggtgagtggactttgtgagccaattatgtgtcggaaggacttggagtctgcccttcttcctgtatgtcatcatcagcccacaaatgcattcagtggcagtgacccagcaccatcaccatcacccactgctcagtctgtcttaggattccttatctttttctccatcatcatagagactgaaatttcaggggtgtttttgtacagtgtatttttttgtgggggggtgatacattggggttttttgtttgcatagagtgggaacggtgtgcaatgtgctcttaccacagaacttaaagtatgaataggctccattcttccgcaccatgggatccataagaagtgctcactttgcgaggtactctgagattagcgttccccatttgtttgacctacagacgttaagtgggtgacttgtgttacacacggggagtaaattcagagatggcacctgtagtctttgcagtctgttgatacttctaaataactaactggatgactttttggggattgaccagcagatgccatctcttgccctcttgattcacctgcttgccttaatttgtccctaaattcaactaaacttcaataagaggggttgtcaaggccatggggcgcacttggaagcactgcctgggctggagcgttggaggcattggcaggcaggtgggaaggagctctcactgcagtgttcacaggcagggaggctgtgtgtggatgtgttagaattgtgtgctgttgcctctcaaaatatccactagaaacaggtgtaaccaggaaaatacaggtctctgctcactgttattaacagactgtcatttcctgacattgggtcatgtggctttactctaggaggctggttctctatttttgtcttagttcaattttctgcatcctcaaatgccaaccccagtatgtggctgggtaggtagaactgtgctgcctgcctgccatgggggctgctctccctccttacccccacgcccacagcccccttggttctgtggtgggcacaggatgtgtttgggtgtgagtaaagtcaaactctgaatgtataatctcttggtagtaatatctgagtggtgttgctactcctgctttttaaaaagacttttcttgccatctataaaaagcttttttctttttcccagcattgctcctgtgctgccacgcttgccctttttccttaccttcctttcagttttctatcaacaactcctctaaacttcagtttaaaataaaaaacagcccaaaaaggctctttgccaccagggggcgtggtaggacacgttgccagtggtctggataggggagcagaaattttgaattttaaaaattagccaccaaggccaggtgcagtggctcacacctgtaatcccagcactttgggaagctgaggcagggggattgcttgagtccaggagttcaagaccagtctgggcaacatagtgagatcccatctctcaaaaaaataataatctagaaaataaagattagccacccagttttctttctccagatgctaaagttgattcctgtttgataacagtattccagaaatgaggggaataacatatctgataggcccaagtcagctctggatagtacagtgtctggatagtacagattctgtgctcctgggacatgctttgtttattcctgccaggccagggattcagcagccctattccccaacccccgttactgtctctgtgggctagccaggctgtccgttatgtaagcacaacaggggcaaggtggggaaaccgtgtgtggaaaaggagtggagtggtggcgggtggccaaggtagactaggaagagtgggtacccagagaccacttgttcagaagttaactcctcttcccatctggcgtgagctactccattgaatggtgccaacaacagtaaagtgaaggagataatgttagattattttcagggatgattctccaagatgacagcagatcttaaaaccaaagagctgggtcctggaagaagggatcttggattattaacttctgatggaaggaccagagtgggagagagaagagttggggacctagaacatcaggaggaccctgggtctttggggatgaggcttcaccatcagctggaagaatccatgcttcacacacatgcctctgccattagtggtactgggatgtttagggtgacatccttgaggggagagccactgaaaagagggacattcacattttgctgtattcttgcagctgtccgtgtcttaataattcaagcgttcaataggtgtttgagggccaggcactgctcttgaggtgctggagataacggtgacaagcccaggtccctgacaagctccacaagcttaatggacagtgaatgtgcggctgttgcggctgttcacagggccgctggtgagggcaggtagaagaaagtgcagaccttcttaaatgcaggtgtaacggatctacatgaaagagcataattaacaccaatgtatacttaaggtagtaacagcttcttcataaagtagcaaaactaaggatctgtgggaaggttgctggtgcaaatgctttataagcttactagagactgagccttggatttaggactttagacgagtataggatggaacaaaatttttgcagtaaatgtaaaaaatgctgtgtaggaggaaggcgtataaggatgccccagctgtaggttctttagattgtctgtagtatttccacgagtaagttgtttttgatgtgtgtactggtattgctggtagatttgaagtggagtctggcggcttcttccacactcccctcccactagcttgtgtcaagatgtgacatcctatgcagcaaaactaggtgagcttgcacccccaggcggtggctctcaactttgtctcattgttcagaaatttcggccaggcgccgtagctcacccctgtaatcccagcactttgggaggccatggcaggtggatcacttgaggtcaggagttcaagaccagcctggccaacacggtgaaaccccgtctctactaaaaatacaaaaattagccaggtgtggtggcacatgcctgtagtcccagctacttggtcaactcaggcaggagaatcacttgaacccaggaggcagaggttgcagtgagctgagatcaagccactccagcctgggtgacagaccgagactctgtctttaaaaaaaaagaaatgtcatctaagccccagtgaacctcctgggaggagagctagccctggccagctgtctccaaagtgactggatgctacagaagaactgggactgtcttctgcacactcgtgcctcctggagttgtcagaacactgagcagtctcctagttctgcgtccgtctagccatggggtctgccatgaaagcctgtggatctgctattgggttggtattttaaactttcacttgggtgaaacttgttcatcattttaaataaagcaacatgatttggagttg

SEQ ID NO: 144792 - DNA, 1898 bp, Homo sapiens
  Payload ID: 8611
  Gene Symbol: JMJD6
  Gene Name: jumonji domain containing 6
  ENST ID: ENST00000542934
  CDS Start-End: 310-1395
cgcagccgacgtgaccttcccaacatggcggaggcccgccgtatgtgaaggagtaccccaggggagccaaagccaatggaaaaccgcgagaggcgtcggggcggggaagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagaacagatacagcacgggcagcggcagtgcaagccacccacagccaccccgtgccactgtgtcccaaccctgacctggagggaccagctctcggggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttctatcttg

SEQ ID NO: 144793 - DNA, 1330 bp, Homo sapiens
  Payload ID: 8611
  Gene Symbol: JMJD6
  Gene Name: jumonji domain containing 6
  ENST ID: ENST00000585429
  CDS Start-End: 29-1216
tagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagt

SEQ ID NO: 144794 - DNA, 5517 bp, Homo sapiens
  Payload ID: 8611
  Gene Symbol: JMJD6
  Gene Name: jumonji domain containing 6
  ENST ID: ENST00000617192
  CDS Start-End: 325-1410
ggggcggggcggtgacgcagccgacgtgaccttcccaacatggcggaggcccgccgtatgtgaaggagtaccccaggggagccaaagccaatggaaaaccgcgagaggcgtcggggcggggaagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagaacagatacagcacgggcagcggcagtgcaagccacccacagccaccccgtgccactgtgtcccaaccctgacctggagggaccagctctcggggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggattagggacacttgtggaggccgggctcacccctgagcagataaagagactctccctgaggtgctttcagcgtaagcttttggcagccacccaactcagttctcgcatcttctgctcctaccttctcctctgtcttctttgaatttggatattccttccctggtccaagctcctatcttcggtcaaatgctgtttttactgcttcctaaggatagattatcaagaaatttaacagctcggccagctcagtgaaacactgaagctaatgggatgttgggtaagaaggttctgtgctgtctcattgaaaaccgagccagtcaaccacaaggctggcagggtgtgatccttgtaacgtcttgtgtctgttacctcacggatgtcggtaaggagtttccacagagccagctgtgtaccacagagactgagagtggtgagtggactttgtgagccaattatgtgtcggaaggacttggagtctgcccttcttcctgtatgtcatcatcagcccacaaatgcattcagtggcagtgacccagcaccatcaccatcacccactgctcagtctgtcttaggattccttatctttttctccatcatcatagagactgaaatttcaggggtgtttttgtacagtgtatttttttgtgggggggtgatacattggggttttttgtttgcatagagtgggaacggtgtgcaatgtgctcttaccacagaacttaaagtatgaataggctccattcttccgcaccatgggatccataagaagtgctcactttgcgaggtactctgagattagcgttccccatttgtttgacctacagacgttaagtgggtgacttgtgttacacacggggagtaaattcagagatggcacctgtagtctttgcagtctgttgatacttctaaataactaactggatgactttttggggattgaccagcagatgccatctcttgccctcttgattcacctgcttgccttaatttgtccctaaattcaactaaacttcaataagaggggttgtcaaggccatggggcgcacttggaagcactgcctgggctggagcgttggaggcattggcaggcaggtgggaaggagctctcactgcagtgttcacaggcagggaggctgtgtgtggatgtgttagaattgtgtgctgttgcctctcaaaatatccactagaaacaggtgtaaccaggaaaatacaggtctctgctcactgttattaacagactgtcatttcctgacattgggtcatgtggctttactctaggaggctggttctctatttttgtcttagttcaattttctgcatcctcaaatgccaaccccagtatgtggctgggtaggtagaactgtgctgcctgcctgccatgggggctgctctccctccttacccccacgcccacagcccccttggttctgtggtgggcacaggatgtgtttgggtgtgagtaaagtcaaactctgaatgtataatctcttggtagtaatatctgagtggtgttgctactcctgctttttaaaaagacttttcttgccatctataaaaagcttttttctttttcccagcattgctcctgtgctgccacgcttgccctttttccttaccttcctttcagttttctatcaacaactcctctaaacttcagtttaaaataaaaaacagcccaaaaaggctctttgccaccagggggcgtggtaggacacgttgccagtggtctggataggggagcagaaattttgaattttaaaaattagccaccaaggccaggtgcagtggctcacacctgtaatcccagcactttgggaagctgaggcagggggattgcttgagtccaggagttcaagaccagtctgggcaacatagtgagatcccatctctcaaaaaaataataatctagaaaataaagattagccacccagttttctttctccagatgctaaagttgattcctgtttgataacagtattccagaaatgaggggaataacatatctgataggcccaagtcagctctggatagtacagtgtctggatagtacagattctgtgctcctgggacatgctttgtttattcctgccaggccagggattcagcagccctattccccaacccccgttactgtctctgtgggctagccaggctgtccgttatgtaagcacaacaggggcaaggtggggaaaccgtgtgtggaaaaggagtggagtggtggcgggtggccaaggtagactaggaagagtgggtacccagagaccacttgttcagaagttaactcctcttcccatctggcgtgagctactccattgaatggtgccaacaacagtaaagtgaaggagataatgttagattattttcagggatgattctccaagatgacagcagatcttaaaaccaaagagctgggtcctggaagaagggatcttggattattaacttctgatggaaggaccagagtgggagagagaagagttggggacctagaacatcaggaggaccctgggtctttggggatgaggcttcaccatcagctggaagaatccatgcttcacacacatgcctctgccattagtggtactgggatgtttagggtgacatccttgaggggagagccactgaaaagagggacattcacattttgctgtattcttgcagctgtccgtgtcttaataattcaagcgttcaataggtgtttgagggccaggcactgctcttgaggtgctggagataacggtgacaagcccaggtccctgacaagctccacaagcttaatggacagtgaatgtgcggctgttgcggctgttcacagggccgctggtgagggcaggtagaagaaagtgcagaccttcttaaatgcaggtgtaacggatctacatgaaagagcataattaacaccaatgtatacttaaggtagtaacagcttcttcataaagtagcaaaactaaggatctgtgggaaggttgctggtgcaaatgctttataagcttactagagactgagccttggatttaggactttagacgagtataggatggaacaaaatttttgcagtaaatgtaaaaaatgctgtgtaggaggaaggcgtataaggatgccccagctgtaggttctttagattgtctgtagtatttccacgagtaagttgtttttgatgtgtgtactggtattgctggtagatttgaagtggagtctggcggcttcttccacactcccctcccactagcttgtgtcaagatgtgacatcctatgcagcaaaactaggtgagcttgcacccccaggcggtggctctcaactttgtctcattgttcagaaatttcggccaggcgccgtagctcacccctgtaatcccagcactttgggaggccatggcaggtggatcacttgaggtcaggagttcaagaccagcctggccaacacggtgaaaccccgtctctactaaaaatacaaaaattagccaggtgtggtggcacatgcctgtagtcccagctacttggtcaactcaggcaggagaatcacttgaacccaggaggcagaggttgcagtgagctgagatcaagccactccagcctgggtgacagaccgagactctgtctttaaaaaaaaagaaatgtcatctaagccccagtgaacctcctgggaggagagctagccctggccagctgtctccaaagtgactggatgctacagaagaactgggactgtcttctgcacactcgtgcctcctggagttgtcagaacactgagcagtctcctagttctgcgtccgtctagccatggggtctgccatgaaagcctgtggatctgctattgggttggtattttaaactttcacttgggtgaaacttgttcatcattttaaataaagcaacatgatttggagttg

SEQ ID NO: 144795 - DNA, 1416 bp, Homo sapiens
  Payload ID: 8612
  Gene Symbol: JMJD7
  Gene Name: jumonji domain containing 7
  Uniprot ID: P0C870
  ENST ID: ENST00000397299
  CDS Start-End: 41-991
gtcggggaaaggcggggtctcggccggcgctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacaccaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtga

SEQ ID NO: 144796 - DNA, 1192 bp, Homo sapiens
  Payload ID: 8612
  Gene Symbol: JMJD7
  Gene Name: jumonji domain containing 7
  ENST ID: ENST00000408047
  CDS Start-End: 243-896
tctcggccggcgctgacgcagccatggcggaggcggctttggaagccgtgcggagcgagttacgagaattcccggccgctgcaaggggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacaccaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggca

SEQ ID NO: 144797 - DNA, 828 bp, Homo sapiens
  Payload ID: 8612
  Gene Symbol: JMJD7
  Gene Name: jumonji domain containing 7
  ENST ID: ENST00000431823
  CDS Start-End: 424-828
gccggcgctgacgcagccatggcggaggcggctttggaagccgtgcggagcgagttacgagaattcccggccgctgcaaggggcccggtgccgtcttgaccgtggtcgcggcgaagccctgtgtttcctacagtcttgagcagcttgctgttacccttgttgaaagctcatcgaaggcacacagctggtgagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaag

SEQ ID NO: 144798 - DNA, 2038 bp, Homo sapiens
  Payload ID: 8613
  Gene Symbol: JMJD8
  Gene Name: jumonji domain containing 8
  Uniprot ID: Q96S16
  ENST ID: ENST00000412368
  CDS Start-End: 58-915
acttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaa

SEQ ID NO: 144799 - DNA, 1015 bp, Homo sapiens
  Payload ID: 8613
  Gene Symbol: JMJD8
  Gene Name: jumonji domain containing 8
  ENST ID: ENST00000562824
  CDS Start-End: 45-749
aaggttcccggcgtgcagcgcggctgcctgagggcggcaggctcatggcgccggcgtcgcggttgctcgcgctctgggcgctggcggctgtggctctacccggctccggggcggagggcgacggcgggtggtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagg

SEQ ID NO: 144800 - DNA, 497 bp, Homo sapiens
  Payload ID: 8613
  Gene Symbol: JMJD8
  Gene Name: jumonji domain containing 8
  ENST ID: ENST00000565258
  CDS Start-End: 1-245
agtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgc

SEQ ID NO: 144801 - DNA, 823 bp, Homo sapiens
  Payload ID: 8613
  Gene Symbol: JMJD8
  Gene Name: jumonji domain containing 8
  ENST ID: ENST00000562111
  CDS Start-End: 28-687
gcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaaggggg

SEQ ID NO: 144802 - DNA, 1901 bp, Homo sapiens
  Payload ID: 8613
  Gene Symbol: JMJD8
  Gene Name: jumonji domain containing 8
  Uniprot ID: Q96S16
  ENST ID: ENST00000609261
  CDS Start-End: 16-810
gagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccac

SEQ ID NO: 144803 - DNA, 5755 bp, Homo sapiens
  Payload ID: 8614
  Gene Symbol: JARID2
  Gene Name: jumonji, AT rich interactive domain 2
  Uniprot ID: Q92833
  ENST ID: ENST00000341776
  CDS Start-End: 245-3985
gttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctgcggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttgg

SEQ ID NO: 144804 - DNA, 5595 bp, Homo sapiens
  Payload ID: 8614
  Gene Symbol: JARID2
  Gene Name: jumonji, AT rich interactive domain 2
  Uniprot ID: Q92833
  ENST ID: ENST00000397311
  CDS Start-End: 582-3806
gggcgggggcgggggctgccgcagagccgggctgcggcgtgggaggaggaagaggaggaagatgcgctcggcctctgccttccgctccggagcgtcgcgcttcccaccaggatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctgcggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtgg

SEQ ID NO: 144805 - DNA, 1287 bp, Homo sapiens
  Payload ID: 8615
  Gene Symbol: JTB
  Gene Name: jumping translocation breakpoint
  Uniprot ID: O76095
  ENST ID: ENST00000271843
  CDS Start-End: 437-877
gcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaa

SEQ ID NO: 144806 - DNA, 1040 bp, Homo sapiens
  Payload ID: 8615
  Gene Symbol: JTB
  Gene Name: jumping translocation breakpoint
  Uniprot ID: O76095
  ENST ID: ENST00000356648
  CDS Start-End: 520-873
accgaacgcccccgggaacaccgggccccgagctcggtcccgcgcccgaggatcctccacggggctagatggctgcgtcgggggcgggagcggaggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggt

SEQ ID NO: 144807 - DNA, 1216 bp, Homo sapiens
  Payload ID: 8615
  Gene Symbol: JTB
  Gene Name: jumping translocation breakpoint
  Uniprot ID: O76095
  ENST ID: ENST00000368589
  CDS Start-End: 696-1049
ctataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggt

SEQ ID NO: 144808 - DNA, 520 bp, Homo sapiens
  Payload ID: 8615
  Gene Symbol: JTB
  Gene Name: jumping translocation breakpoint
  Uniprot ID: O76095
  ENST ID: ENST00000428469
  CDS Start-End: 170-520
aataggcaactccggccttccctgccctgacctggaacctctgggagggctgcagatatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccata

SEQ ID NO: 144809 - DNA, 1820 bp, Homo sapiens
  Payload ID: 8616
  Gene Symbol: JUNB
  Gene Name: jun B proto-oncogene
  Uniprot ID: P17275
  ENST ID: ENST00000302754
  CDS Start-End: 277-1320
gagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaa

SEQ ID NO: 144810 - DNA, 1863 bp, Homo sapiens
  Payload ID: 8617
  Gene Symbol: JUND
  Gene Name: jun D proto-oncogene
  Uniprot ID: P17535
  ENST ID: ENST00000252818
  CDS Start-End: 139-1182
aggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgcca

SEQ ID NO: 144811 - DNA, 500 bp, Homo sapiens
  Payload ID: 8617
  Gene Symbol: JUND
  Gene Name: jun D proto-oncogene
  ENST ID: ENST00000600972
  CDS Start-End: 1-500
gcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccagagagaagaacagagtgttcgattctg

SEQ ID NO: 144812 - DNA, 1700 bp, Homo sapiens
  Payload ID: 8618
  Gene Symbol: JDP2
  Gene Name: Jun dimerization protein 2
  Uniprot ID: Q8WYK2
  ENST ID: ENST00000267569
  CDS Start-End: 194-718
ctgaagagggccttttgctgctcgccttcactctcagtcttggggccttccccatcatcttgcttctcgccttctggatctcctcgacttttggaagccgcgtgacctacgtcattcagattccaagagagaggtcatcctgggtgattccttagctccaagaagaggcttggtggttgattctccaagattcatggtagcaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacata

SEQ ID NO: 144813 - DNA, 5401 bp, Homo sapiens
  Payload ID: 8618
  Gene Symbol: JDP2
  Gene Name: Jun dimerization protein 2
  Uniprot ID: Q8WYK2
  ENST ID: ENST00000435893
  CDS Start-End: 274-765
gccccagcccagccccgcggggaggctcccgcagcccagggacctcgagctttccccgcgccgggcgctgcagccgggcccctcccgcgaggcgcccggcagcctgaggcttccttttggttcccgccccgggacgggaggctccgtccgctccctggacagccggggtgctccctccttctccctcccgcgctctcctcccccgtccgtttgcagggaggtgctctcctcgggcggcggggaaggcggggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctcattttacagatggtttaactgaggctcagagaaggtaagcgacttatccaaggtaacccagctagcaagggatagagctggtgtttgaactctccctccagaggcctgtgactctcctcctgtcaccaacccactatgattgtcctcatggttgaataggaagcttatgaggccacagttatagatttagtttctgggaaggctggatagagttccaggttgtcccatgatcacagagtgaaccaactaccctggtcaatgtgtgtctgacccagggaagggtgtggatggcttctctgccccctcacctcgacagctgaatccctgccacccagggccggagcagctcagtggcattcactcagtgcctgctgtgtacctggcactcggcagttctcaaggcatgtcacgcatgaggaaggcgggagaggtgtttttagcttccttgtatactgaagcttgcaaaggctacagtttacccaactaaacttgactcctgcattctaatcatgtgttctttctcctccatccctggacttaggataactagttgctggtgatgacttcgtgtcaagaacagcagtgaacctgggttgcttcccaaattgtggacgaggccttctgggatgggcagaagtggagaatggtgattaacacacctgtgatccctccctcgctcactcctctcagtttccctccacccaacacacttggtgtggactcccctgcaccccgccctagaaacaggacctggtcctctcactgtcagctgtggcagaaggttgtggcagcgggttgccttctgtctcgggggtcttgaggctgtcggtccggacgatgcaggtgaggcagtgtcagttctgcatcaggaacccctcgcgctgtaatcctttgatatttttcaagccatgagaaaaatgaagtggacttaccagggtccctccagtgacctagtggatgttcttacaggactgccgtgtgccactggctgtggcttccctggtcctgtgcttggccaccgggagctggcatctccaaaatagagcctccttagcctgtgcaggtgggctgtcttccaaagtcaccacaccagtgacttgtgctgtgcggagccttcctcaccaggaccactggctgctcctgtggctagaagtcacaattataggcttcattgcaagagccagcatttgagtttcttctgggcacctgccactgtgcatgtgtgacctcaactgctttgtgcaccctgactggggggtaggtgctagcgttccaacattacagatgagaaaaccgaggcacacagaagaggtaacctgcccaaggtcacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggtaattattttgtcctctgttagtgtcggtagttattgatatctacatagtacaggttatttaaatatgttttattctgtaaagatgggctgccaagtttgtgttctgaccctgtacgtggtccctatggtgtgatgaatgcctgggatcgcagactcctggatctgttcagctcctgactggtcacaaccagccatgctggatgcatcattccctccctgggcctcagtgtgccctcctgccaggtggtcacacataagacctgtgccacctctgcccagggttcctatgagaatcaatcgagttgatgaatgcaaccatggcctgagaaagacaagacgctttagctatcagatgggcagaaacaagtatgtgttggtaagaatatggattaaaggttgggaggccaagatgggtggatcatgaggtcagaagattgagaccaccctggataacacggtgaaaccctgtctctactaataatacaaaaaattagccgggcatggtggcacgtgcctgtagtcccagctactcgggaggctgaggcaggagaatcacttggacctgggaggtggaggttgcagtgagccaagattgcgccactgcactccagcctgggtgacagagcgagactccatctcaaaaaaaacaaaacaaaaaaaatgtggattaaaggaaacttagatatgctgccagtgagaaactgtgcaaagcaatttggaaataaccagtaaaactaaagctaaacgcatcctttgacctagcagttttcctcctagtcttgggaggaactctagcacaggggcaaaaggaaatgtacaagaatgttcactgatggctttgtttgtatttttaaaaagttgaaaacaacctaaatgatgatcagcataagaacaaataaattgtggtattttcctaaaattgaatattactcaacaggtaaaaaagaatgaaccagagctatatgtatcaatatggataaatctcagaaacctactgttgagatggagggtaggggagtgaactgcggaaggataccacttatgtcatatttctaactaaatgtatacgttgatactttattgtttatggctacacacacatctgggtaatagaggtataaaagcctgcacaagaatgctgtcaatatcacaatcagtcatagggagtgctcctgggagggccgcggagaggagggaactagggatgccactgcaagggtaagtaggacgctggacttcaacttcaactatacacataacatttcatttatttttttaaaatccccatcaaatgtagaatgacaggatttttcagaggtgggtgatgtgtgcacagatgtgggctatcttctccacactcctctgtatatttgatattctttgcaataaaagagaacaagccacaatacaaa

SEQ ID NO: 144814 - DNA, 3775 bp, Homo sapiens
  Payload ID: 8618
  Gene Symbol: JDP2
  Gene Name: Jun dimerization protein 2
  Uniprot ID: Q8WYK2
  ENST ID: ENST00000437176
  CDS Start-End: 60-551
cccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctcattttacagatggtttaactgaggctcagagaaggtaagcgacttatccaaggtaacccagctagcaagggatagagctggtgtttgaactctccctccagaggcctgtgactctcctcctgtcaccaacccactatgattgtcctcatggttgaataggaagcttatgaggccacagttatagatttagtttctgggaaggctggatagagttccaggttgtcccatgatcacagagtgaaccaactaccctggtcaatgtgtgtctgacccagggaagggtgtggatggcttctctgccccctcacctcgacagctgaatccctgccacccagggccggagcagctcagtggcattcactcagtgcctgctgtgtacctggcactcggcagttctcaaggcatgtcacgcatgaggaaggcgggagaggtgtttttagcttccttgtatactgaagcttgcaaaggctacagtttacccaactaaacttgactcctgcattctaatcatgtgttctttctcctccatccctggacttaggataactagttgctggtgatgacttcgtgtcaagaacagcagtgaacctgggttgcttcccaaattgtggacgaggccttctgggatgggcagaagtggagaatggtgattaacacacctgtgatccctccctcgctcactcctctcagtttccctccacccaacacacttggtgtggactcccctgcaccccgccctagaaacaggacctggtcctctcactgtcagctgtggcagaaggttgtggcagcgggttgccttctgtctcgggggtcttgaggctgtcggtccggacgatgcaggtgaggcagtgtcagttctgcatcaggaacccctcgcgctgtaatcctttgatatttttcaagccatgagaaaaatgaagtggacttaccagggtccctccagtgacctagtggatgttcttacaggactgccgtgtgccactggctgtggcttccctggtcctgtgcttggccaccgggagctggcatctccaaaatagagcctccttagcctgtgcaggtgggctgtcttccaaagtcaccacaccagtgacttgtgctgtgcggagccttcctcaccaggaccactggctgctcctgtggctagaagtcacaattataggcttcattgcaagagccagcatttgagtttcttctgggcacctgccactgtgcatgtgtgacctcaactgctttgtgcaccctgactggggggtaggtgctagcgttccaacattacagatgagaaaaccgaggcacacagaagaggtaacctgcccaaggtcacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggt

SEQ ID NO: 144815 - DNA, 972 bp, Homo sapiens
  Payload ID: 8618
  Gene Symbol: JDP2
  Gene Name: Jun dimerization protein 2
  Uniprot ID: Q8WYK2
  ENST ID: ENST00000419727
  CDS Start-End: 158-649
cctgctttctcgagcgctcctgcaccgtggggtggcggagccgggggactgcatggaacccgggacgcccccgcggggagaggagcgcgagcggccgcgggaggagggcgcccaaggcggcgggggaggttaaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctggg

SEQ ID NO: 144816 - DNA, 631 bp, Homo sapiens
  Payload ID: 8618
  Gene Symbol: JDP2
  Gene Name: Jun dimerization protein 2
  ENST ID: ENST00000559060
  CDS Start-End: 231-631
ggacgctcggcggccgcgacggggggcgctggcggcggcggacgctgcagcggcggcggggctggcgccgcggcggctcccgggccgggacaggcctgggcaccgggcggagctccgcggccgggcggcagcggcgcggagcgggcacggcgcctgcagccgggccccggccccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccg

SEQ ID NO: 144817 - DNA, 3540 bp, Homo sapiens
  Payload ID: 8619
  Gene Symbol: JUN
  Gene Name: jun proto-oncogene
  Uniprot ID: P05412
  ENST ID: ENST00000371222
  CDS Start-End: 1258-2253
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataa

SEQ ID NO: 144818 - DNA, 9042 bp, Homo sapiens
  Payload ID: 8620
  Gene Symbol: JMY
  Gene Name: junction mediating and regulatory protein, p53 cofactor
  Uniprot ID: Q8N9B5
  ENST ID: ENST00000396137
  CDS Start-End: 463-3429
agtcaggccggctccgggctttctgcagcagcaccaggggcgggggcggggatcttgacctgggcgagcgaccgggacgcatacagcgccggcctgaccccgcgggacccgcgcctcaccaccggagcgccgcagacgcagctccacggcctcgcgcggggggcggcgggcggccgcgaggcgctgcggcagcgcggagcttgtaaacagatccggccgcaggtgaccatgtgaactacctgctcccgggacgcttattgtccttctctcgatccgcgccacaaaggagctcggcggtcggggcgcggagggacaggcgaacgagccgggagagccggccggcgcactaagatggctgaaggcgcccggcgagggtgagcggggggcgcggcgcagccagcggggagtcctcgggcgggccgggccggcggcccttccccgcggcgagaagccggagccaccatgtcgttcgcgctggaggagacgctcgagtcggactgggtggctgtgcggccccatgtgttcgacgagcgcgagaaacacaaattcgtctttattgtggcctggaacgagattgagggcaagtttgccataacctgccacaaccggacggcccagaggcagaggagcggctcccgggagcaagcgggggcgcgagggggcgccgaggccggcggagctgcgtccgacgggagccgcgggcccggcagcccggcgggcaggggtcggcccgaggccactgcctctgcaactctggttaggagccccgggccccggcggagctcggcctgggcggagggcggctctcctcggagcactcgcagccttctgggggacccgcggctgcggagtcctggcagcaaaggggcggagagtcgtcttaggagcccagtgcgggccaaacccatcccgggtcagaaaacatctgaagccgacgatgcggcgggggcagccgctgcagcagcccggccggcgcccagagaggcccaggtgtcctctgtacggatagtgagcgcctctgggacggtctccgaggagatagaggtgctggaaatggtgaaggaggacgaggcacctctggcgctctcggacgcggagcagccgccgcccgccaccgagctggagtctccggccgaagagtgcagctgggccggactgttttctttccaggacctgcgcgccgtgcaccagcagctgtgctcggtgaactcgcagttggagccgtgcctgccggtgttccccgaggaaccttcgggcatgtggactgtgctgtttgggggcgcccccgagatgaccgagcaggaaatcgacactctgtgttaccagctccaggtctacctgggccacggcctggacacctgcggctggaagatcctctcccaggtgctcttcaccgagaccgatgatcccgaggagtattacgaaagcctcagcgagctgcggcagaagggctacgaagaagtgcttcagcgggccaggaagcgcatccaggagctcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagagatgcagagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaaggaaatatgtattgcaaaacacaatgaaaaaatccaacagcgcactcggattgaagatgaatatagaacccatcacacagtacaactaaagagagaaaaattacatgatgaagaagaaagaaaaagtgcctgggttagccaagagagacagagaacactggatagacttcgaacatttaaacagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggcgtgagcctctgtgcccagcctgacaaaatcttttatttatttaaatgttagtaatacgtttattgatgagactaggagcttctctgcagcatcttcataatacattggttttagttcccacactattcccacatcttatctgggaagattagaaatacagatgtaatatggaagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataagtctctagcaaagagtggagggtggagggtgtgtagaactccactcagcctcatggatacatctacaagtctctcaacccatcctgttacagttctccatgagagtcacctcacacttggaaaagaaggaggttaaagcagagtattgttggcagccagctatgcccatcctcttgtaaataactttccaacacacccatttccttgccttaaggtgcaggttcctacttctacaaaatttcaaatgattgcaggtcaaaaacctttggagttactcacaaataataataaaatttcaaataactagggtctacttgtccatcaagatgacattaccagtggaacccacctgttaattttaaagtagcttcagaacccaacaaaaattatgtaagcctggttaaatgtccttttttcttcttgcctctaataaaatcaggatcttcggccttgatactaaatatgtgtatatttagttatgatggtacttgtagatgctcacatttccagttccaaactcgcccgtactttttatgtgcttcaaaatattggacacatttctgttaatatatgatttctgtatccacaaaccgctgtttgcttatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggattttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaattaa

SEQ ID NO: 144819 - DNA, 3200 bp, Homo sapiens
  Payload ID: 8621
  Gene Symbol: JUP
  Gene Name: junction plakoglobin
  Uniprot ID: P14923
  ENST ID: ENST00000310706
  CDS Start-End: 120-2357
ggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttg

SEQ ID NO: 144820 - DNA, 3298 bp, Homo sapiens
  Payload ID: 8621
  Gene Symbol: JUP
  Gene Name: junction plakoglobin
  Uniprot ID: P14923
  ENST ID: ENST00000393930
  CDS Start-End: 218-2455
catgctttctggaggcctgcacagacctttcccacccgctttcctgaaagaatttgacagggaaagtgagaccgcaggaaggctttttgggggaaggtttcttcaatgctagactctctcaggcagagctgcatcgggccccctgccttccctgctcccaatttcctgagaccgcccccccccacccagaattggggatcttgatcaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttg

SEQ ID NO: 144821 - DNA, 3497 bp, Homo sapiens
  Payload ID: 8621
  Gene Symbol: JUP
  Gene Name: junction plakoglobin
  Uniprot ID: P14923
  ENST ID: ENST00000393931
  CDS Start-End: 120-2357
ggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttg

SEQ ID NO: 144822 - DNA, 1069 bp, Homo sapiens
  Payload ID: 8621
  Gene Symbol: JUP
  Gene Name: junction plakoglobin
  ENST ID: ENST00000449889
  CDS Start-End: 177-1069
tgtgggggccgagcgcacattttcccagcgactctggccccacctgccgagcaggtgagcgcacggagtccagaggccctgccctccagctcccagagcctcgtcgatactacctgcggcgcctccctccacgccggtgggagcccggctctggcttcttcagcggagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacgg

SEQ ID NO: 144823 - DNA, 1029 bp, Homo sapiens
  Payload ID: 8621
  Gene Symbol: JUP
  Gene Name: junction plakoglobin
  ENST ID: ENST00000437187
  CDS Start-End: 143-1029
ctagagccgactggcagtccccggggccaatggcaagcggataaacagaggcggccgtggaagaggactggaggcgaggctccgcccctccacgggacagtcaggcgagatagccagtgagctcgcaccagaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggc

SEQ ID NO: 144824 - DNA, 949 bp, Homo sapiens
  Payload ID: 8621
  Gene Symbol: JUP
  Gene Name: junction plakoglobin
  ENST ID: ENST00000424457
  CDS Start-End: 243-949
tgagttgctgccttggccagagtccggagcagccgccgcccgaccacgccgagctcagttcgctgtccgcgccggctcccaccccggcccgaccccgacccggcccggtcaggccccatactcagcctctgacctctgcaggtcagttcccaggacagtggagccaaacacagaccaagcgggaagttcacctccctggtacaaagttcggccctgctactcattaaccttcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcag

SEQ ID NO: 144825 - DNA, 586 bp, Homo sapiens
  Payload ID: 8621
  Gene Symbol: JUP
  Gene Name: junction plakoglobin
  ENST ID: ENST00000437369
  CDS Start-End: 327-586
catgctttctggaggcctgcacagacctttcccacccgctttcctgaaagaatttgacagggaaagtgagaccgcaggaaggctttttgggggaaggtttcttcaatgctagactctctcaggcagagctgcatcgggccccctgccttccctgctcccaatttcctgagaccgcccccccccacccagaattggggatcttgatcaggcctctgacctctgcaggtcagttcccaggacagtggagccaaacacagaccaagcgggaagttcacctccctggtacaaagttcggccctgctactcattaaccttcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcggga

SEQ ID NO: 144826 - DNA, 915 bp, Homo sapiens
  Payload ID: 8621
  Gene Symbol: JUP
  Gene Name: junction plakoglobin
  ENST ID: ENST00000420370
  CDS Start-End: 86-915
cccaggggacctcagaagctgctagaagccctgagtgccttctcttgcccctgggagagttgggtcagggcagcaagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgct

SEQ ID NO: 144827 - DNA, 432 bp, Homo sapiens
  Payload ID: 8621
  Gene Symbol: JUP
  Gene Name: junction plakoglobin
  ENST ID: ENST00000465293
  CDS Start-End: 425-432
ttaccgtttggggaacttgctgccgctggtctctttggggccaccctcaccccaccccacgcgtcatcctcgctttccctccctccctactcccccaggcctgggtggggccctattgtttgcgcccagcttgcccaactgtgggggccgagcgcacattttcccagcgactctggccccacctgccgagcaggtgagcgcacggagtccagaggccctgccctccagctcccagagcctcgtcgatactacctgcggcgcctccctccacgccggtgggagcccggctctggcttcttcagcggagcctctgacctctgcaggtcagttcccaggacagtggagccaaacacagaccaagcgggaagttcacctccctggtacaaagttcggccctgctactcattaaccttcagtagccacgatggaggt

SEQ ID NO: 144828 - DNA, 583 bp, Homo sapiens
  Payload ID: 8621
  Gene Symbol: JUP
  Gene Name: junction plakoglobin
  ENST ID: ENST00000591690
  CDS Start-End: 272-583
gtggcgaggggcgtggcttggctgtcaggtctcttcgccttttgttcggttactgagttgctgccttggccagagtccggagcagccgccgcccgaccacgccgagctcagttcgctgtccgcgccggctcccaccccggcccgaccccgacccggcccggtcaggccccatactcaggtgcgggctatcgggggcgcaggtatcgttggggacagaggggtggcgagcggccgcggggccggtcccagccgtccctgggcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacc

SEQ ID NO: 144829 - DNA, 4209 bp, Homo sapiens
  Payload ID: 8622
  Gene Symbol: JAM2
  Gene Name: junctional adhesion molecule 2
  Uniprot ID: P57087
  ENST ID: ENST00000312957
  CDS Start-End: 541-1329
gggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaattgtgcagtgacattccgggccaagtcccttagtcaggggttgacaattctgcttttggacaaggagggatgtggagggaagaagtaatagtctaccaggaaaatgagacgaaaaagctcagtatgactccctgcatctggtacccctcttgaaacacagtgggcacatgagcaatggctcaaacgaaaagtggatctaatgtgggtttctcaaccgatgaaccacaaaagcttccagctactattacaatgtgaaaattccaatgatccgtttaccagagcaattagactatgttaaaaattcatatcatttgtaacttcttttaattactgaattgatattaaaaacaaaatatggctagggcatgtcctattcttctgggcaaatgtggatgaaaaggtcacttgctacctttgacaactatgaacatgatggttaatcttctttctttttttttttttttttttgagacggagtctcactctgtcgcccaggctggagtacagtggcacaatcttggctcactgcaacctccgcctcccctccgcctcccagattcaagcacttctcctgcctcagcctcccaagtagctgagattataggcgtgtaccaccacacctggctaatttttgtattttagtagagaagggtttcaccatgttggccaggctggtctcaaacctctgacctcaaatgatccacccccatcagcctcccaaagtgctgggattataggcatgagccactgcactgggcaggttaatcttctttcaaaagagtctgctctttctacccaattggcgaagcaaatccccaggattcaccgaacaaatggattaagcacccactgagtgcctagcatgtgcctggacaccaggccaccgggaagatgctccccctttgacttgtctatgacatgctatgtctctcaccagatcccttcctggaggtcgggcttctgtaacatggctctgcccccaaaataaaattttcaccacgagtcagggatcggcaaacattttctgtaaagagccagaaagtagatattttaagtcataaggtccctgttaacaactacttgactctgccattgtagcacaaaggcagccacagacaaaacaagcaagtagtcatgtctgtgttccaataagactttatttacaaaaacagcaggcacagacaagatttggcccacaggcatagattcccaactcatggtggtgaagtacagaaaaaaacacctgtctacaagcttttgtaagaaatcaggctaaatgttacctatgttttggttggaagatttctttggtttgaggaatgctttcctcttgcattggcatgccaagaggatagatgactctgaaagacgcctcttcagacatacctgtcatcacacaagatcaacttcttcagtttaaatgacacaaatccatattgtggaaggaaaatatgtagtgccttagcttcactaatagttgtaaaacttctttttaagacatcaaaggctagaggattcattttatgcagtgcgaacatctaataacactctctgtgtcaaatatatattgtacattaccttaaactattgtaatagctaggtaaaaatccttgtataaaagaatgttttcccccacacaaagggcagagtattgagcactaatttcctattaaaagtatatatatgtatctgtgggtcactggtgtccagacttgtatttgcatttgtgtttacttgaggaacttgaacactaacaactggtaaaatcccattgtaattcttacagcattttgactttattttcctgcagtgaattgtgttgtgtaaagattagggctttaaaatcttattagcaagctttgttttgttttaattattgttgctgttgtaactagatttaatttatttttagttggaggtttgacctaagtctggaccaattgattgcttttcaatacaactttgcaaagaacttcctttttccacaggtggctttgttcgattaaagtctacact

SEQ ID NO: 144830 - DNA, 1757 bp, Homo sapiens
  Payload ID: 8622
  Gene Symbol: JAM2
  Gene Name: junctional adhesion molecule 2
  Uniprot ID: P57087
  ENST ID: ENST00000400532
  CDS Start-End: 551-1489
agccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgtgcagtggctcacgcctgtaatcccagcactttggaaggccgcggcgggcggatcacgaggtcaggagttctagaccagtctggccaatatggtgaaaccccatctctactaaaatacaaaaattagctgggcatggtggcatgtgcctgcagttccagctgcttgggagacaggagaatcacttgaacccgggaggcggaggttgcagtgagctgagatcacgccactgcagtccagcctgggtaacagagcaagattccatctcaaaaaataaaataaataaataaataaatactggtttttacctgtagaattcttacaataaatatagcttgatattc

SEQ ID NO: 144831 - DNA, 4337 bp, Homo sapiens
  Payload ID: 8622
  Gene Symbol: JAM2
  Gene Name: junctional adhesion molecule 2
  Uniprot ID: P57087
  ENST ID: ENST00000480456
  CDS Start-End: 551-1447
agccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctatcataaggcctatgggttttctgccccaaaagaccaacaagtagtcacagcagtagagtaccaagaggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccagaagagtaattcttcatctaaagccacgacaatgagtgaaaatgatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaattgtgcagtgacattccgggccaagtcccttagtcaggggttgacaattctgcttttggacaaggagggatgtggagggaagaagtaatagtctaccaggaaaatgagacgaaaaagctcagtatgactccctgcatctggtacccctcttgaaacacagtgggcacatgagcaatggctcaaacgaaaagtggatctaatgtgggtttctcaaccgatgaaccacaaaagcttccagctactattacaatgtgaaaattccaatgatccgtttaccagagcaattagactatgttaaaaattcatatcatttgtaacttcttttaattactgaattgatattaaaaacaaaatatggctagggcatgtcctattcttctgggcaaatgtggatgaaaaggtcacttgctacctttgacaactatgaacatgatggttaatcttctttctttttttttttttttttttgagacggagtctcactctgtcgcccaggctggagtacagtggcacaatcttggctcactgcaacctccgcctcccctccgcctcccagattcaagcacttctcctgcctcagcctcccaagtagctgagattataggcgtgtaccaccacacctggctaatttttgtattttagtagagaagggtttcaccatgttggccaggctggtctcaaacctctgacctcaaatgatccacccccatcagcctcccaaagtgctgggattataggcatgagccactgcactgggcaggttaatcttctttcaaaagagtctgctctttctacccaattggcgaagcaaatccccaggattcaccgaacaaatggattaagcacccactgagtgcctagcatgtgcctggacaccaggccaccgggaagatgctccccctttgacttgtctatgacatgctatgtctctcaccagatcccttcctggaggtcgggcttctgtaacatggctctgcccccaaaataaaattttcaccacgagtcagggatcggcaaacattttctgtaaagagccagaaagtagatattttaagtcataaggtccctgttaacaactacttgactctgccattgtagcacaaaggcagccacagacaaaacaagcaagtagtcatgtctgtgttccaataagactttatttacaaaaacagcaggcacagacaagatttggcccacaggcatagattcccaactcatggtggtgaagtacagaaaaaaacacctgtctacaagcttttgtaagaaatcaggctaaatgttacctatgttttggttggaagatttctttggtttgaggaatgctttcctcttgcattggcatgccaagaggatagatgactctgaaagacgcctcttcagacatacctgtcatcacacaagatcaacttcttcagtttaaatgacacaaatccatattgtggaaggaaaatatgtagtgccttagcttcactaatagttgtaaaacttctttttaagacatcaaaggctagaggattcattttatgcagtgcgaacatctaataacactctctgtgtcaaatatatattgtacattaccttaaactattgtaatagctaggtaaaaatccttgtataaaagaatgttttcccccacacaaagggcagagtattgagcactaatttcctattaaaagtatatatatgtatctgtgggtcactggtgtccagacttgtatttgcatttgtgtttacttgaggaacttgaacactaacaactggtaaaatcccattgtaattcttacagcattttgactttattttcctgcagtgaattgtgttgtgtaaagattagggctttaaaatcttattagcaagctttgttttgttttaattattgttgctgttgtaactagatttaatttatttttagttggaggtttgacctaagtctggaccaattgattgcttttcaatacaactttgcaaagaacttcctttttccacaggtggctttgttcgattaaagtctacactaataaaaata

SEQ ID NO: 144832 - DNA, 1025 bp, Homo sapiens
  Payload ID: 8622
  Gene Symbol: JAM2
  Gene Name: junctional adhesion molecule 2
  ENST ID: ENST00000460679
  CDS Start-End: 1-785
aggctattttagcctgcaaaaccccaaagaagactgtttcctccagattagagtggaagaaactgggtcggagtgtctcctttgtctactatcaacagactcttcaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctgcaatttaatactgtttccaaactggacactggagaatattcctgtgaagcccgcaattctgttggatatcgcaggtgtcctgggaaacgaatgcaagtagatgatctcaacataagtggcatcatagcagccgtagtagttgtggccttagtgatttccgtttgtggccttggtgtatgctatgctcagaggaaaggctacttttcaaaagaaacctccttccaatctggcagacctaactttggctctatgggcgtagagagaagatggatgacaaactatctgaggctatggcagctgggagtggagaagatatactgaagccatggcttcagacagtttgtcatctcctaattcctttgaagaatcatctgccattgacttcctgttcccagatttctggctcaatcctggtctctcagtctcgaagagtaattcttcatctaaagccacgacaatgagtgaaaatgatttcaagcacacaaaatcctttataatttaaagactccactttagagatacaccaaagccaccgttgttacacaagttattaaactatta

SEQ ID NO: 144833 - DNA, 3912 bp, Homo sapiens
  Payload ID: 8623
  Gene Symbol: JAM3
  Gene Name: junctional adhesion molecule 3
  Uniprot ID: Q9BX67
  ENST ID: ENST00000299106
  CDS Start-End: 160-1092
tagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaacccaaacattgcttcattctttgttatttgctcttacgttgggtttgtctcttcttcctagcatttcagtggttaggcatgcacactaaaaatgctatcaatcacccatccaccagggaagtcagtgctgggcaggaggtcagcctgtgtgctcaagagcagtgctgcgcctctccgccaccgagcccacctgtgttgcggttcccacttgggatggcagtgggcagatctcagtggcatcccatcccccaaa

SEQ ID NO: 144834 - DNA, 3363 bp, Homo sapiens
  Payload ID: 8623
  Gene Symbol: JAM3
  Gene Name: junctional adhesion molecule 3
  Uniprot ID: Q9BX67
  ENST ID: ENST00000441717
  CDS Start-End: 14-793
agcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcaggtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtgttcactgctgttcacaaggacgactctgggcagtactactgcattgcttccaatgacgcaggctcagccaggtgtgaggagcaggagatggaagtctatgacctgaacattggcggaattattgggggggttctggttgtccttgctgtactggccctgatcacgttgggcatctgctgtgcatacagacgtggctacttcatcaacaataaacaggatggagaaagttacaagaacccagggaaaccagatggagttaactacatccgcactgacgaggagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaaccc

SEQ ID NO: 144835 - DNA, 564 bp, Homo sapiens
  Payload ID: 8623
  Gene Symbol: JAM3
  Gene Name: junctional adhesion molecule 3
  ENST ID: ENST00000532252
  CDS Start-End: 14-130
agcaaccctcgacatggcgctgaggcggccaccgcgactccggctctgcgctcggctgcctgacttcttcctgctgctgcttttcagggagtcaagtctagtctgctttccaaggctgcattctaagtagtgaagcctcaacttcatatttacctaaagcaggacaccacactcttcccctggcagccatccgcaggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaag

SEQ ID NO: 144836 - DNA, 385 bp, Homo sapiens
  Payload ID: 8623
  Gene Symbol: JAM3
  Gene Name: junctional adhesion molecule 3
  ENST ID: ENST00000534549
  CDS Start-End: 14-385
agcaaccctcgacatggcgctgaggcggccaccgcgactccggctctgcgctcggctgcctgacttcttcctgctgctgcttttcaggggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattcc

SEQ ID NO: 144837 - DNA, 1138 bp, Homo sapiens
  Payload ID: 8624
  Gene Symbol: JSRP1
  Gene Name: junctional sarcoplasmic reticulum protein 1
  Uniprot ID: Q96MG2
  ENST ID: ENST00000300961
  CDS Start-End: 66-1061
gtcctgtccacaaggctcagcaaagcggctggcggcctggcctgggacctgctgctgctccagccatgtccatgacaaccagagcctgggaggagctggatggcggcctgggcagctgccaggccctggaggaccactctgcgctggccgagacccaggaggacagggcttcagcgacacccaggctggccgactccggcagcgtgccccacgactctcaggtggctgaaggccccagtgtggacaccaggcccaagaagatggaaaaagagcctgccgccagggggaccccaggaacggggaaggagaggctgaaagccggagcgagccctcggagcgtccccgcgcgcaagaaggcgcagaccgcgccgcccctgcagccgccgccgccgcccccggccctgagcgaggagctgccctggggagacctgtcgctcaacaagtgcctggtgctcgcctcgctggtggcgctgctgggctcggctttccagctgtgccgcgacgccgtccctggggaggcagcactccaagcacgtgtgcccgagccctgggtcccgccaagctcagccccgagggagccatcgtcgcccctgcctaagttcgaggcccaggcgcctccatcagcgccgcctgcgccccgggccgaggcagaggtcagacccaagattcccgggagtcgggaggctgcagagaacgacgaagaggagcccggcgaggccaccggagaggccgtccgggaggaccgtgtgaccctcgcagaccggggacccaaggagaggcctcggagagaggggaagccgcggaaggagaagccgcggaaggaggagagacctaagaaagagaggccgcggaaagaggagaggccacgggccgccagggagccccgggaagccctaccccagcgctgggagtcacgcgaagggggccaccggccgtgggcacgggactccagggacgccgagcccaggaagaagcaggcctgggtgtccccgaggcgtcccgacgaggagcagcggcctgggagtcgccagaagctccgcgcaggcaaggggcgggactgagccggccccgcgccggagtccaggggccccttctggacgccccgcgactctggcgaaataaagcgagtgctgcggcc

SEQ ID NO: 144838 - DNA, 843 bp, Homo sapiens
  Payload ID: 8624
  Gene Symbol: JSRP1
  Gene Name: junctional sarcoplasmic reticulum protein 1
  ENST ID: ENST00000593238
  CDS Start-End: 61-843
gggcggggcacttacctctcactgctgctgccgccgcggctgtgcaggcttaggagcggcatggtgcggctggcgtggatggtggcgctgggtttatccccttccttctctctggcgaagcagtggctattgaggatccgctgcagggaggatttcaccatccggccgctggggtccgaaaccaggaaaacctccgctgcgtctctccgcgccgccgccgctgctcgccgttcgcaaaatggcgcctctgccgccgcccgcctttatagatgctgcgcccaggccacgccccccgcgccgccgggaacgcgaccgcacgaggggcagagccgcggggccgccgggaaaaaaagtcgcgcccgcccctcccagcgcctgattggtgaaagggaaagggaaaggaagaggctctctggagattggttgcctggcctgggacctgctgctgctccagccatgtccatgacaaccagagcctgggaggagctggatggcggcctgggcagctgccaggccctggaggaccactctgcgctggccgagacccaggaggacagggcttcagcgacacccaggctggccgactccggcagcgtgccccacgactctcaggtggctgaaggccccagtgtggacaccaggcccaagaagatggaaaaagagcctgccgccagggggaccccaggaacggggaaggagaggctgaaagccggagcgagccctcggagcgtccccgcgcgcaagaaggcgcagaccgcgccgcccctgcagccgccgccgccgcccccggccctgagcgaggagctgccctggggagacctgtcgctcaacaagtgcctggtg

SEQ ID NO: 144839 - DNA, 4378 bp, Homo sapiens
  Payload ID: 8625
  Gene Symbol: JPH1
  Gene Name: junctophilin 1
  Uniprot ID: Q9HDC5
  ENST ID: ENST00000342232
  CDS Start-End: 42-2027
gtccgtgcccctgcggggagcgcgccggggctgccccccgaatgacgggcggaaggttcgacttcgacgatggcggcacctactgcggcggctgggaggagggcaaggcgcacgggcatggcatctgcacggggcccaagggccagggcgagtactcgggctcctggtcgcacggcttcgaggtggtcggaggctacacctggcccagcggcaacacctaccagggctactgggcgcagggcaagcggcacgggctgggggtggagacgaagggcaagtggatgtaccggggggagtggtcacatggtttcaaggggcgctacggggtccggcagagcctgtgcacccccgctcgctacgagggtacctggagtaacgggctgcaagacgggtacggcgtggagacctacggggacggaggtacctaccagggccagtgggccggaggcatgcggcatggctacggcgtgcgccagagcgtgccctacggcatggccacggtgatccgctcaccgctgcgtacctcgctggcctcgctgcgcagcgagcagagcaatggcagcgtgctccacgacgccgcagccgccgccgacagcccggccggcacccgcggcggtttcgtgctcaacttccacgcagacgctgagctagcgggcaagaagaagggcggcctcttccggaggggctcccttcttggaagcatgaaacttcgcaagtccgaatccaagtcttccatctcgagcaagcgcagctctgtccgcagcgacgcggccatgagcagaattagttccagcgatgccaactccacgatcagctttggcgatgtagattgtgatttttgcccggtggaagaccacgtggacgccaccaccacggaaacctacatgggcgagtggaagaacgacaagcgcaacggcttcggcgttagcgagcgctccaatggcatgaagtatgaaggggagtgggcaaataacaagaggcatggatatggctgtaccgtgtttcctgacggctccaaagaagagggaaaatacaaaaataatattctggtccgtgggataaggaagcagcttataccaataagacatacaaaaactagggagaaggtggacagagcaattgaaggcgcccaaagggcagctgccatggccagaaccaaagtggaaatagcaaattcaaggactgcacatgccagagcgaaggccgatgccgccgaccaggccgcgctggccgctcgccaggagtgcgacatcgcgagagctgtggccagggagctgtcacctgatttctaccaaccaggccctgattacgtcaaacagagatttcaggaaggtgtagatgctaaagaaaatccagaagaaaaggtaccagaaaagccacctacaccaaaggagtctcctcatttttatcgcaaaggcacgacacccccaagatctcctgaggcaagtcccaaacacagccactctcctgcttcctccccaaagcccctgaagaagcaaaaccccagctcaggggcgagactcaaccaagacaaaaggagtgtggctgatgagcaggtgacggccattgtcaataagcccttgatgtcaaaggctcccacgaaggaggcaggagcggttgtgccccagtccaagtactctggccgccaccacatccccaaccccagtaacggggagctgcattctcagtatcacggctactacgtgaagctgaacgccccccagcaccctccagtagacgtggaggacggcgatggatccagccagtcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggccctaattcaatcatgattgtccttgtcatgctgttgaatatcgggttggccattctttttgttcactttctaacttgattggaattaggaaagtgaagtcctgacaactagtggtgtgttagcccacagttctctgcagtggtgccgtcagccctttaaatggcccaccccaggcagactcagacacagggaaggaggcttggaattaggatgggatcgcgagagagatgaaacttggaaaattcagccagaggacctgttcggttcccctgggagtgctttgtggctttggggtcctctgggagctgaagcacacggccatgttggagagcaaaacttaataataattcttttttaaaatctgctgaagcagccccatccggcgaagttcttggcattggctactccatctgtcctagcagagtgtgactaaactggaaatgtatggagctgcattttttttttttttttgatggaagtcaacagctgccttactattttaccatctgacgtttttagtagggagctggggaaacgactgcccgaggaatgcggtcggaggattgtgttgctgtggacgtggttccaacattcactcctatctcattagaagaaataggtagcagcatcactcaccagtcttatgccatgacctgctgctttaacatctcctggaatgttctgggagagaacgtttcgtttgcttgtgcacgactctgttcatttttgctgtttatttaaatctgacgtatagtcatctaccacctgcggtcctggccggacgaaacacacgtgttgcatctcaaggaaaagaaacaacaaaatgctagtgaaaatgtgcttattttgatagcaatataccatcttttatgtcatttattcttcctatacttgtaaaaggttatttatctttaaaatttagcaatttgaagacactatgccttcctaagaactaatttaattctaaatatttttaacattactgaggtgaattatttatgcacttaggaagtgctaaattttaaaagctgaaacacaacagaattctaagaaatatagtccaaacgttgcatggattgcagtaatcagtgtttaaaggattcagtttctttgctgacgtactttacaaccaaataaaatcttgtcggtggctgtgttaattcccatgaaagttaagcaagatgctattaataaactgctctgctctttcttgttttctttttccaacttaaatttctgttgaatacattcaggtagaacataaagccttgttcaatcactgcctctcagttttctgcctttcctgtttttcaaagtccttttgtaatttcatttcacattttaaaggcttagacatttttattttaaatatgtgtcttttacagtcttttgtcattctgacatttctggatttttgctgttttataatttaccctttgttattcagaagcatgcttacttatagaaactaaatggtctttataaaagtaattacttaaaaagaaatcaggggaagaaagatatctatctaatctattaaatctttataaaacattacattgcagagggggagctactcctaaatattttcatgatttgcatggtttaatcagatttttttttttttttacaccatattagctaccttttcaatggagaagagacagttcacacaattccctggttagcacagatgtggactgagtgctttgtcacctgcagggtagtaacccagtgatgtttcttacagaagcacaatatgttgaaaatcctgggtgtgaccaatatggaataaagaagaaggcagaaagagagcaaatgaaaaatttcaacttgtatattcattttttacattttgctttgacttttaaatttaggaagtccgtttttacctgagaacaaatgtttaaagttcctgcgtcactctcagtactctcactgcccctcccaaaccctatagctccttacgctgggaaagctggttttttaaaaaaataataataaaatatttaatcttattaagtgttcatttaaaatgcgtaatgctttggaaataatgggtaacagatagcgagaggatatgtttataaagtgagcatgttggtcccatttataaatatatgtatgatttataagcttttttaaaacaaagctcaaattgttggtatttttctaaaatgtgcacagctgtattttacatgaaggctctttctaatgggttgttatactgtactcaacattttggacagcacatgaagtctgccaatgtacttaataaaacatgactttgtttatttaaagtttcttgctgtgaaaaagaactccctacctgtgagttcctttatttataattcttgaaaccaaaatgtataatgtacagttttcacaactgtatctgctctaataaaaaaaagttggttattaatgaa

SEQ ID NO: 144840 - DNA, 1651 bp, Homo sapiens
  Payload ID: 8625
  Gene Symbol: JPH1
  Gene Name: junctophilin 1
  ENST ID: ENST00000519947
  CDS Start-End: 41-280
tccgtgcccctgcggggagcgcgccggggctgccccccgaatgacgggcggaaggtacctaccagggccagtgggccggaggcatgcggcatggctacggcgtgcgccagagcgtgccctacggcatggccacggtgatccgctcaccgctgcgtacctcgctggcctcgctgcgcagcgagcagagcaatggcagcgtgctccacgacgccgcagccgccgccgacagcccggccggcacccgcggcggtttcgtgctcaacttccacgcagacgctgagctagcgggcaagaagaagggcggcctcttccggaggggctcccttcttggaagcatgaaacttcgcaagtccgaatccaagtcttccatctcgagcaagcgcagctctgtccgcagcgacgcggccatgagcagaattagttccagcgatgccaactccacgatcagctttggcgatgtagattgtgatttttgcccggtggaagaccacgtggacgccaccaccacggaaacctacatgggcgagtggaagaacgacaagcgcaacggcttcggcgttagcgagcgctccaatggcatgaagtatgaaggggagtgggcaaataacaagaggcatggatatggctgtaccgtgtttcctgacggctccaaagaagagggaaaatacaaaaataatattctggtccgtgggataaggaagcagcttataccaataagacatacaaaaactagggagaaggtggacagagcaattgaaggcgcccaaagggcagctgccatggccagaaccaaagtggaaatagcaaattcaaggactgcacatgccagagcgaaggccgatgccgccgaccaggccgcgctggccgctcgccaggagtgcgacatcgcgagagctgtggccagggagctgtcacctgatttctaccaaccaggccctgattacgtcaaacagagatttcaggaaggtgtagatgctaaagaaaatccagaagaaaaggtaccagaaaagccacctacaccaaaggagtctcctcatttttatcgcaaaggcacgacacccccaagatctcctgaggcaagtcccaaacacagccactctcctgcttcctccccaaagcccctgaagaagcaaaaccccagctcaggggcgagactcaaccaagacaaaaggagtgtggctgatgagcaggtgacggccattgtcaataagcccttgatgtcaaaggctcccacgaaggaggcaggagcggttgtgccccagtccaagtactctggccgccaccacatccccaaccccagtaacggggagctgcattctcagtatcacggctactacgtgaagctgaacgccccccagcaccctccagtagacgtggaggacggcgatggatccagccagtcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggccctaattcaatcatgattgtccttgtcatgctgttgaatatcgggttggccattctttttgttcactt

SEQ ID NO: 144841 - DNA, 1923 bp, Homo sapiens
  Payload ID: 8626
  Gene Symbol: JPH2
  Gene Name: junctophilin 2
  Uniprot ID: Q9BR39
  ENST ID: ENST00000342272
  CDS Start-End: 389-778
ctttgaaaaggctggggacccctccaccccaccctttcactgggcttcttaaagagatcacaccgttttcccttggacttcttggaaggcagacttgggacgctttgtggggactttgaacctttccttcctgctttctttccagcaggcagccttgctctggctggtggagtcggggctcccgggcatggcactgactagccgacccggtgctgacttggcgccggggctctttcagcctctgctggcatcctgcttcccccctcctggggtgcagtggtgagtctgggggcctgcccccgagggcactggaggagtgttgcaggcatcacccacgccctctgcacccacgctggaggacggggaggttgtcaggggctatgatgagatgagtgggggccgcttcgactttgatgatggaggggcgtactgcgggggctgggaggggggaaaggcccatgggcatggactgtgcacaggccccaagggccagggcgaatactctggctcctggaactttggctttgaggtggcaggtgtctacacctggcccagcggaaacacctttgagggatactggagccagggcaaacggcatgggctgggcatagagaccaaggggcgctggctctacaagggcgagtggacacatggcttcaagggacgctacggaatccggcagagctcaagcagcggtgccaagtatgagggcacctggaacaatggcctgcaagacggctatggcaccgagacctatgctgatggagggatgtgttaaaatcgccctcagaatatggtcgagacaatgaaacaagacaatgaagcactgagcatcatgcctggcacataggaaatgccaaaatatatattcccgtatttccttcacattccaaagggtgaattaattcaggatggcctgaaccatagctgtcactgtcttcgggaggatatttgaggacaaaaacgagtttttgactttggaacagtaaataagacaagactttgattcgcttagttctgccttgagtcctgccagtgtagatggaatccatgccagacatgattccatttcgaatgtagaatcagcataatttaacctcatcttggaaatctcatgtcccagttcacagccaggcatcagcgtgacagtcagctgagctgctgtcttggcagcttctgggcattctatggagaccccaggagagcacagcagacccttagcagaacagaaaagcggaccgtattagtctttcctgtccacggccttgttttcagtgattcatgtgcccgattggccaaatctctgcagacgtgcccctgtccgaggccaggcttctgggattcatcgagcttgcttgtttccgggacctgctaattccgtgcccagcagctgttccccggagcaggccctgccctccacaccctcatgaggaatgccgagtctcattttctgagggccctggttgagggtggggtgtggggcgagggggacagggttgcttcctgccatagacttcctgccttggagggttatccttgttctcacctatcccttcccgagctgaagccacagagtaggagagaagttagggctggcacacctccctcccgtgtaactttcactccctgcttaaagggaactgatgagagttgcctggcacagatctgtgcctggcagaatccacagagcagcccaggtgtgctaggaactccagagtgacccctgctccaggccaggaatgagcaccttgtgcctggaggtcttcctgccactgctggctgcccattgctgtggatggggtagagctggagtcacacatggaggctggacagctgcatgcagcctgcaggggacactctggatggcatgtaccatgtttttattatttctatttttaattaaattggaatcctttatggata

SEQ ID NO: 144842 - DNA, 4787 bp, Homo sapiens
  Payload ID: 8626
  Gene Symbol: JPH2
  Gene Name: junctophilin 2
  Uniprot ID: Q9BR39
  ENST ID: ENST00000372980
  CDS Start-End: 874-2964
ggattttcagtgttccaggactgggtgttctgctggtctccctctcccctcccttccccgattccccggtgccctccctgcgcgcagacccaggggactctgagaatggaagggagctctcattcccgggaggaaaagacaccaggttccctgggctgcctgcactcagttctcagcctccttcctcatgcctccagccactgcccgggtctgcggcacgggcgcgatttgaaatacccctccttcccgctttgaagaaggctgggctggctgggggttattttgggagcagcttctgagatccaatggccttgttagggcaacactgacctttccgtcccagaaggagggcaggattggagaagggggcggggcagcggcggggagaccgacagccccgcacacccactggggtggagaagggggccagcgggctgcgggaattcagcctccggcgggggctgccaccgaggggaatttcccctctttgaaaaggctggggacccctccaccccaccctttcactgggcttcttaaagagatcacaccgttttcccttggacttcttggaaggcagacttgggacgctttgtggggactttgaacctttccttcctgctttctttccagcaggcagccttgctctggctggtggagtcggggctcccgggcatggcactgactagccgacccggtgctgacttggcgccggggctctttcagcctctgctggcatcctgcttcccccctcctggggtgcagtggtgagtctgggggcctgcccccgagggcactggaggagtgttgcaggcatcacccacgccctctgcacccacgctggaggacggggaggttgtcaggggctatgatgagatgagtgggggccgcttcgactttgatgatggaggggcgtactgcgggggctgggaggggggaaaggcccatgggcatggactgtgcacaggccccaagggccagggcgaatactctggctcctggaactttggctttgaggtggcaggtgtctacacctggcccagcggaaacacctttgagggatactggagccagggcaaacggcatgggctgggcatagagaccaaggggcgctggctctacaagggcgagtggacacatggcttcaagggacgctacggaatccggcagagctcaagcagcggtgccaagtatgagggcacctggaacaatggcctgcaagacggctatggcaccgagacctatgctgatggagggacgtaccaaggccagttcaccaacggcatgcgccatggctacggagtacgccagagcgtgccctacgggatggccgtggtggtgcgctcgccgctgcgcacgtcgctgtcgtccctgcgcagcgagcacagcaacggcacggtggccccggactctcccgcctcgccggcctccgacggccccgcgctgccctcgcccgccatcccgcgtggcggcttcgcgctcagcctcctggccaatgccgaggcggccgcgcgggcgcccaagggcggcggcctcttccagcggggcgcgctgctgggcaagctgcggcgcgcagagtcgcgcacgtccgtgggtagccagcgcagccgtgtcagcttccttaagagcgacctcagctcgggcgccagcgacgccgcgtccaccgccagcctgggagaggccgccgagggcgccgacgaggccgcacccttcgaggccgatatcgacgccaccaccaccgagacctacatgggcgagtggaagaacgacaaacgctcgggcttcggcgtgagcgaacgctccagtggcctccgctacgagggcgagtggctggacaacctgcgccacggctatggctgcaccacgctgcccgacggccaccgcgaggagggcaagtaccgccacaacgtgctggtcaaggacaccaagcgccgcatgctgcagctcaagagcaacaaggtccgccagaaagtggagcacagtgtggagggtgcccagcgcgccgctgctatcgcgcgccagaaggccgagattgccgcctccaggacaagccacgccaaggccaaagctgaggcagcggaacaggccgccctggctgccaaccaggagtccaacattgctcgcactttggccagggagctggctccggacttctaccagccaggtccggaatatcagaagcgccggctgctgcaggagatcctggagaactcggagagcctgctggagccccccgaccggggcgccggcgcagcgggcctcccacagccgccccgcgagagcccgcagctgcacgagcgtgagacccctcggcccgagggtggctccccgtcaccggccgggacgcccccgcagcccaagcggcccaggcccggggtgtccaaggacggcctgctgagcccaggcgcctggaacggcgagcccagcggtgagggcagccggtcagtcactccgtccgagggcgcgggccgccgcagccccgcgcgtccagccaccgagcgcatggccatcgaggctctgcaggcaccgcctgcgccgtcgcgggagccggaggtggcgctttaccagggctaccacagctatgctgtgcgcaccacgccgcccgagcccccaccctttgaggaccagcccgagcccgaggtctccgggtccgagtccgcgccctcgtccccggccaccgccccgctgcaggcccccacgctccgaggccccgagcctgcacgcgagacccccgccaagctggagcccaagcccatcatccccaaagccgagcccagggccaaggcccgcaagactgaggctcgagggctgaccaaggcgggggccaagaagaaggcgcggaaggaggccgcactggcggcagaggcggaggtggaggtggaagaggtccccaacaccatcctcatctgcatggtgatcctgctgaacatcggcctggccatcctctttgttcacctcctgacctgaccgtcgcttaccagagccagaagttcctgctgaggacatgaggacccgtctttttgcagtgccaggcagggtggccaaagaggactggactctggacctggagccccgtggtccagttcacattcaccccacaagagtttcaggaggcctcccacggtgcctgtgctgggtggcggtggtggtgccaagaggaatggaatgtcctgggctccttcaggagctctctacccaggggcaaggagagcccagagagaagcgccctggtctcttgagcttcctgatctgctcctgtcccccgctctcctccactcccttgcctttccctaggttgtcccctccctgggcttttgtgtgttttgggagatgtcacctaaccaggacattgatattcaatcccatcccccttcctcccaccctgccccactttgatttaatcctttggctgtgggctgaggcctcccagggaagctgggtggggtgggtgttgagaccccctcagaccagcacagagacctgtccttgtgcagtctgcaccctgcactccctcccttgcctgtagatgttctggatgacagtagaggaaatggacaaggtcagtttgaatatcccagaacacagtgctctgtctcctcccaccagtccagttagcttcccttctggaccaatagacgaggggagaccccatggatcctctggctgggaagccactgaccaggtggccagggggcagggtgggaagaggggttaaggtgcagtgatgatggcctgttttggagtgtgtctgagactgggattgcatttggggtttcccgtgtgcttgggatgctagagggtcacctgcaggaggcctggggccggcgagaaatctcctgtgatgccctgtgaaatggcttgtctcctcccccatcagggcccaccgaaagctcaggggagcacagaagcccatggaagcccagggagatgtccctggggcagacactaaggcaggtgttgaagacaagctgcttgtcaagaagcatttcccggcaagagaggggcaagtctggggctccaactgggtacagcctgggtgcagttataagcccctttggcttacttggtagaagatggctacttggatgtacctcacttaaagatgttttgtaccacactaggtctctgggcccttgtgcttcctgtgggtggggtgagggccaaaggctatggtttcctgcctccaggagaatggagagaaagggcttccaggcccctccaagcctggggaaggacgtggcatccaagctgagccagagggaactgctgctgtcctcccttcatttctgtggaccttggaggctttggctttgtggcagggcctccccaggcagctctgggacctaggagtttgcttctgatagggtcagctttcccatttcccttcaatgcttgggaaccttctcccttagcttcacacttgccgtttcaagccctgctgggaccttgtggcttggctggaatccaggactgtattttcatggagaagaacctgcagattcttccatcctcagctggccatggcccacagctctgcatctgcatctgagcttctcaagactcctggagcatgaggggaatggggcggggccactgctctgtgctgacgggctccgtctcggagattcttgtcctgttttttttctgttgtttttttttggctggtgctggggacaagcctgtgcctgccaaagctcccaggccaagtttgggggctggtgtttggggttgggtttggggttcaggatgctgcagtctgtgcaataataaacccgcatctgctcacgggc

SEQ ID NO: 144843 - DNA, 3985 bp, Homo sapiens
  Payload ID: 8627
  Gene Symbol: JPH3
  Gene Name: junctophilin 3
  Uniprot ID: Q8WXH2
  ENST ID: ENST00000284262
  CDS Start-End: 243-2489
agcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaaa

SEQ ID NO: 144844 - DNA, 4278 bp, Homo sapiens
  Payload ID: 8628
  Gene Symbol: JPH4
  Gene Name: junctophilin 4
  Uniprot ID: Q96JJ6
  ENST ID: ENST00000356300
  CDS Start-End: 793-2679
tgggggtctcagtgcatctccttctcctctctgcctgcctcctccctcaccgaagggttagcggacacccatccttttctgcttggggaccccaccaccacccgcaacactgccgctgtctcttcttcaccgtatccttctctacccaccctcttctctcttctcttctccctgcccctttaaatctgcctggcccagcctcccccgtgatgctgggatggagcaaacattgatttgtgctgggatggaatcggaattttgatttatttttcctctcccaaccataagaagaaaaaaataataaaaacaccccctcttgagagccccctccccctttgcatccagctcccagctcttcttccctatctccatccaaggcagattttttcccctacactattctcatcttcccccacccttgccactacctcgcccccccacccagcctgctcctccagctggggagagaggggactctccggactcccccacctttcctctctgggttggagcagtctctccggaaggggagggggcttggcttgtccgggcgaggtgggagtggaggtatcctgccatggatgctgtgccggggaggcagcctgagccccagcccacatgccactcaggatgagggtccggccctgcctgccctcgctggggcccccccgcccggccccggtctaactgcccccgccccgaggcctcgcccggctccaaggcccccagcaggctctccagtcccaggatgcgctgagccgccggggggctgaggccgcgccaactacatgcatgtcccccgggggcaagttcgactttgacgacgggggctgctacgtggggggctgggaggcggggcgggcacatggctacggcgtgtgcacgggccccggcgcccagggcgagtacagcggctgctgggcacacggcttcgagtcactgggcgtcttcacggggcccggcggacacagctaccagggccactggcagcagggcaagcgcgaagggctgggcgtggagcgcaagagccgctggacgtaccgcggcgagtggctgggcgggctgaaggggcgcagcggcgtgtgggaaagcgtgtccggcctgcgctacgccgggctctggaaggacggtttccaggacggctacggcactgagacctactccgacggaggcacctaccagggccagtggcaggccgggaagcgccacggctacggggtacgccagagtgtgccctaccatcaggcggcgctgctgcgctcgccccgccgcacctccctggattccggccacagcgaccccccgacgccacccccgcccctgcccttgccgggcgacgagggaggcagccccgcctcgggctcccggggcggcttcgtgctggccgggcccggggacgccgacggcgcgtcgtcccgaaagcgcactccggcggccggcggattctttcgccgttcgctgctgctcagcgggctccgagcgggcggacgtcgcagctccctgggcagcaagcgaggctccctgcgcagcgaggtgagcagcgaggtgggcagcaccggaccgcccggctcggaggccagcgggcccccggccgcagcgccgcccgccctcatcgagggctcggccacagaggtgtacgcgggcgagtggcgcgcagatcggcgcagcggcttcggcgtcagccagcgctccaacgggctgcgctacgagggcgagtggctgggcaaccggcggcacggctacgggcgcaccacccgccccgacggctcccgcgaggagggcaagtacaagcgcaaccggctggtgcacggcgggcgcgtccgcagtctcctgcctctggcccttcggcggggcaaggttaaggagaaggtggacagggctgtcgagggcgcccgtcgagccgtgagtgctgcccgtcagcgccaggagatcgccgctgccagggcagcagacgccctcctaaaggcagtggcagccagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggg

SEQ ID NO: 144845 - DNA, 4386 bp, Homo sapiens
  Payload ID: 8628
  Gene Symbol: JPH4
  Gene Name: junctophilin 4
  Uniprot ID: Q96JJ6
  ENST ID: ENST00000397118
  CDS Start-End: 904-2790
atctccttctcctctctgcctgcctcctccctcaccgaagggttagcggacacccatccttttctgcttggggaccccaccaccacccgcaacactgccgctgtctcttcttcaccgtatccttctctacccaccctcttctctcttctcttctccctgcccctttaaatctgcctggcccagcctcccccgtgatgctgggatggagcaaacattgatttgtgctgggatggaatcggaattttgatttatttttcctctcccaaccataagaagaaaaaaataataaaaacaccccctcttgagagccccctccccctttgcatccagctcccagctcttcttccctatctccatccaaggcagattttttcccctacactattctcatcttcccccacccttgccactacctcgcccccccacccagcctgctcctccagctggggagagaggggactctccggactcccccacctttcctctctgggttggagcagtctctccggaaggggagggggcttggcttgtccgggcgaggtgggagtggaggtatcctgccatggatgctgtgccggggaggcagcctgagccccagcccacatgagacgccgaagaaccggggcagaggggtcctgacagcagccagggaaacgggtgccctacgattctgcccagccccctctcaggacccccaaactgccatccacactcgacacttcggggttctagccactcaggatgagggtccggccctgcctgccctcgctggggcccccccgcccggccccggtctaactgcccccgccccgaggcctcgcccggctccaaggcccccagcaggctctccagtcccaggatgcgctgagccgccggggggctgaggccgcgccaactacatgcatgtcccccgggggcaagttcgactttgacgacgggggctgctacgtggggggctgggaggcggggcgggcacatggctacggcgtgtgcacgggccccggcgcccagggcgagtacagcggctgctgggcacacggcttcgagtcactgggcgtcttcacggggcccggcggacacagctaccagggccactggcagcagggcaagcgcgaagggctgggcgtggagcgcaagagccgctggacgtaccgcggcgagtggctgggcgggctgaaggggcgcagcggcgtgtgggaaagcgtgtccggcctgcgctacgccgggctctggaaggacggtttccaggacggctacggcactgagacctactccgacggaggcacctaccagggccagtggcaggccgggaagcgccacggctacggggtacgccagagtgtgccctaccatcaggcggcgctgctgcgctcgccccgccgcacctccctggattccggccacagcgaccccccgacgccacccccgcccctgcccttgccgggcgacgagggaggcagccccgcctcgggctcccggggcggcttcgtgctggccgggcccggggacgccgacggcgcgtcgtcccgaaagcgcactccggcggccggcggattctttcgccgttcgctgctgctcagcgggctccgagcgggcggacgtcgcagctccctgggcagcaagcgaggctccctgcgcagcgaggtgagcagcgaggtgggcagcaccggaccgcccggctcggaggccagcgggcccccggccgcagcgccgcccgccctcatcgagggctcggccacagaggtgtacgcgggcgagtggcgcgcagatcggcgcagcggcttcggcgtcagccagcgctccaacgggctgcgctacgagggcgagtggctgggcaaccggcggcacggctacgggcgcaccacccgccccgacggctcccgcgaggagggcaagtacaagcgcaaccggctggtgcacggcgggcgcgtccgcagtctcctgcctctggcccttcggcggggcaaggttaaggagaaggtggacagggctgtcgagggcgcccgtcgagccgtgagtgctgcccgtcagcgccaggagatcgccgctgccagggcagcagacgccctcctaaaggcagtggcagccagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaa

SEQ ID NO: 144846 - DNA, 1124 bp, Homo sapiens
  Payload ID: 8628
  Gene Symbol: JPH4
  Gene Name: junctophilin 4
  ENST ID: ENST00000544177
  CDS Start-End: 24-905
agaattacagaactcatttaaggatgacaaggcatctacgattaacagcagagggtgaaagggaagagaaaactgaggaagcatctgacatcacagggagaactgagaagcaacagtggggaaggactgatcagactcccaggctgcctgcacctaaggagcagggaagggcagcagacgccctcctaaaggcagtggcagccagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcact

SEQ ID NO: 144847 - DNA, 3489 bp, Homo sapiens
  Payload ID: 8628
  Gene Symbol: JPH4
  Gene Name: junctophilin 4
  ENST ID: ENST00000622501
  CDS Start-End: 1-1890
atgcatgtcccccgggggaagttcgactttgacgacgggggctgctacgtggggggctgggaggcggggcgggcacatggctacggcgtgtgcacgggccccggcgcccagggcgagtacagcggctgctgggcacacggcttcgagtcactgggcgtcttcacggggcccggcggacacagctaccagggccactggcagcagggcaagcgcgaagggctgggcgtggagcgcaagagccgctggacgtaccgcggcgagtggctgggcgggctgaaggggcgcagcggcgtgtgggaaagcgtgtccggcctgcgctacgccgggctctggaaggacggtttccaggacggctacggcactgagacctactccgacggaggcacctaccagggccagtggcaggccgggaagcgccacggctacggggtacgccagagtgtgccctaccatcaggcggcgctgctgcgctcgccccgccgcacctccctggattccggccacagcgaccccccgacgccacccccgcccctgcccttgccgggcgacgagggaggcagccccgcctcgggctcccggggcggcttcgtgctggccgggcccggggacgccgacggcgcgtcgtcccgaaagcgcactccggcggccggcggattctttcgccgttcgctgctgctcagcgggctccgagcgggcggacgtcgcagctccctgggcagcaagcgaggctccctgcgcagcgaggtgagcagcgaggtgggcagcaccggaccgcccggctcggaggccagcgggcccccggccgcagcgccgcccgccctcatcgagggctcggccacagaggtgtacgcgggcgagtggcgcgcagatcggcgcagcggcttcggcgtcagccagcgctccaacgggctgcgctacgagggcgagtggctgggcaaccggcggcacggctacgggcgcaccacccgccccgacggctcccgcgaggagggcaagtacaagcgcaaccggctggtgcacggcgggcgcgtccgcagtctcctgcctctggcccttcggcggggcaaggttaaggagaaggtggacagggctgtcgagggcgcccgtcgagccgtgagtgctgcccgtcagcgccaggagatcgccgctgccagggcagcagacgccctcctaaaggcagtggcagccagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaatatattaataaaaaagttcaaaaaaggg

SEQ ID NO: 144848 - DNA, 3109 bp, Homo sapiens
  Payload ID: 8629
  Gene Symbol: KAT2A
  Gene Name: K(lysine) acetyltransferase 2A
  Uniprot ID: Q92830
  ENST ID: ENST00000225916
  CDS Start-End: 55-2568
ccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccaaattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtgtga

SEQ ID NO: 144849 - DNA, 404 bp, Homo sapiens
  Payload ID: 8629
  Gene Symbol: KAT2A
  Gene Name: K(lysine) acetyltransferase 2A
  ENST ID: ENST00000588759
  CDS Start-End: 1-213
ggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaa

SEQ ID NO: 144850 - DNA, 2990 bp, Homo sapiens
  Payload ID: 8629
  Gene Symbol: KAT2A
  Gene Name: K(lysine) acetyltransferase 2A
  ENST ID: ENST00000465682
  CDS Start-End: 1-831
cagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttattt

SEQ ID NO: 144851 - DNA, 4833 bp, Homo sapiens
  Payload ID: 8630
  Gene Symbol: KAT2B
  Gene Name: K(lysine) acetyltransferase 2B
  Uniprot ID: Q92831
  ENST ID: ENST00000263754
  CDS Start-End: 456-2954
ccgcgggcagcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgctagtcccctccctcctgggggagcagctgccgccgctgccgccgccgccaccaccatcagcgcgcggggcccggccagagcgagccgggcgagcggcgcgctagggggagggcgggggcggggaggggggtgggcgaagggggcgggagggcgtggggggagggtctcgctctcccgactaccagagcccgagagggagaccctggcggcggcggcggcgcctgacactcggcgcctcctgccgtgctccggggcggcatgtccgaggctggcggggccgggccgggcggctgcggggcaggagccggggcaggggccgggcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggccgaggagtcttgtaaatgtaatggctggaaaaaccctaacccctcacccactccccccagagccgacctgcagcaaataattgtcagtctaacagaatcctgtcggagttgtagccatgccctagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaagctcttgagaaagtctattttacaaagaggaaaacctgtggttgaaggctctttggaaaagaaacccccatttgaaaaacctagcattgaacagggtgtgaataactttgtgcagtacaaatttagtcacctgccagcaaaagaaaggcaaacaatagttgagttggcaaaaatgttcctaaaccgcatcaactattggcatctggaggcaccatctcaacgaagactgcgatctcccaatgatgatatttctggatacaaagagaactacacaaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaaatttctgtccatgctagaagaagaagtatatagtcaaaactctcccatctgggatcaggattttctctcagcctcttccagaaccagccagctaggcatccaaacagttatcaatccacctcctgtggctgggacaatttcatacaattcaacctcatcttcccttgagcagccaaacgcagggagcagcagtcctgcctgcaaagcctcttctggacttgaggcaaacccaggagaaaagaggaaaatgactgattctcatgttctggaggaggccaagaaaccccgagttatgggggatattccgatggaattaatcaacgaggttatgtctaccatcacggaccctgcagcaatgcttggaccagagaccaattttctgtcagcacactcggccagggatgaggcggcaaggttggaagagcgcaggggtgtaattgaatttcacgtggttggcaattccctcaaccagaaaccaaacaagaagatcctgatgtggctggttggcctacagaacgttttctcccaccagctgccccgaatgccaaaagaatacatcacacggctcgtctttgacccgaaacacaaaacccttgctttaattaaagatggccgtgttattggtggtatctgtttccgtatgttcccatctcaaggattcacagagattgtcttctgtgctgtaacctcaaatgagcaagtcaagggctatggaacacacctgatgaatcatttgaaagaatatcacataaagcatgacatcctgaacttcctcacatatgcagatgaatatgcaattggatactttaagaaacagggtttctccaaagaaattaaaatacctaaaaccaaatatgttggctatatcaaggattatgaaggagccactttaatgggatgtgagctaaatccacggatcccgtacacagaattttctgtcatcattaaaaagcagaaggagataattaaaaaactgattgaaagaaaacaggcacaaattcgaaaagtttaccctggactttcatgttttaaagatggagttcgacagattcctatagaaagcattcctggaattagagagacaggctggaaaccgagtggaaaagagaaaagtaaagagcccagagaccctgaccagctttacagcacgctcaagagcatcctccagcaggtgaagagccatcaaagcgcttggcccttcatggaacctgtgaagagaacagaagctccaggatattatgaagttataaggttccccatggatctgaaaaccatgagtgaacgcctcaagaataggtactacgtgtctaagaaattattcatggcagacttacagcgagtctttaccaattgcaaagagtacaacccccctgagagtgaatactacaaatgtgccaatatcctggagaaattcttcttcagtaaaattaaggaagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtaaattttctatggcatgtccattagctatttcatgatagatgattaggggtttcctcaaaacctgtgtgtgaggaaattgcacacagtagcaaaatttggggaaatccataacattttcagaccatgaatgaatgtttccatttttttctaatggaatgtgagagtttacttttattttattctgaaggactttaaggaagggatacatgattttaaaaaagcctgtaagaggtgaaatatgtgatgtttgaagtctctttatagactttttatatatattttttaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagcttccaa

SEQ ID NO: 144852 - DNA, 2296 bp, Homo sapiens
  Payload ID: 8631
  Gene Symbol: KAT5
  Gene Name: K(lysine) acetyltransferase 5
  Uniprot ID: Q92993
  ENST ID: ENST00000341318
  CDS Start-End: 235-1875
agaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgc

SEQ ID NO: 144853 - DNA, 2059 bp, Homo sapiens
  Payload ID: 8631
  Gene Symbol: KAT5
  Gene Name: K(lysine) acetyltransferase 5
  Uniprot ID: Q92993
  ENST ID: ENST00000352980
  CDS Start-End: 251-1636
acgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgcca

SEQ ID NO: 144854 - DNA, 2237 bp, Homo sapiens
  Payload ID: 8631
  Gene Symbol: KAT5
  Gene Name: K(lysine) acetyltransferase 5
  Uniprot ID: Q92993
  ENST ID: ENST00000377046
  CDS Start-End: 273-1814
agcttcgcacccggtgggcgtcacgtgacggactcagtagaccgccactggctgtgcacgttatggggtttccacctagggctcggcctgaggcttgtaacactccgttttcccccgagtcacaggggcagtcttgcccctcgcagctgggtcgcggtgtctctcaaaggtccccctctacaggggcttcgtgaggcccgggcccacagggcgctcggtcccggaagtgacgtctcccagaggggccggaagtggcagtggagggagggaagatggcggaggtgggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgcca

SEQ ID NO: 144855 - DNA, 1875 bp, Homo sapiens
  Payload ID: 8631
  Gene Symbol: KAT5
  Gene Name: K(lysine) acetyltransferase 5
  ENST ID: ENST00000534650
  CDS Start-End: 545-1453
gggtggcacttgtgactgaaggaggcttaggagagacctaagtgctggagcttagggatccggcctgggggtggagttcaggtcgtggaagggtggagtctcatagcctggcctgtctaaggcccctgtctatgctattctcatagccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgcc

SEQ ID NO: 144856 - DNA, 1697 bp, Homo sapiens
  Payload ID: 8631
  Gene Symbol: KAT5
  Gene Name: K(lysine) acetyltransferase 5
  Uniprot ID: Q92993
  ENST ID: ENST00000530446
  CDS Start-End: 30-1514
ggccggaagtggcagtggagggagggaagatggcggaggtggtgagtccggtgcccggggcggggcggagggagccaggggaggtgggtagagcccgaggccccccagtagccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttgaccaagtgtgacctacgacatcctccaggcaatgagatttaccgcaagggcaccatctccttctttgagattgatggacgtaagaacaagagttattcccagaacctgtgtcttttggccaagtgtttccttgaccataagacactgtactatgacacagaccctttcctcttctacgtcatgacagagtatgactgtaagggcttccacatcgtgggctacttctccaaggagaaagaatcaacggaagactacaatgtggcctgcatcctaaccctgcctccctaccagcgccggggctacggcaagctgctgatcgagttcagctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaatgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcag

SEQ ID NO: 144857 - DNA, 583 bp, Homo sapiens
  Payload ID: 8631
  Gene Symbol: KAT5
  Gene Name: K(lysine) acetyltransferase 5
  ENST ID: ENST00000534681
  CDS Start-End: 447-583
ggaagcttttctacgtccattacattgactgtgagttctgggcctgaggtggggcatcagggtagggttgggggacagtctttggcattctgtcctgagccatccccactgctacagtcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacatt

SEQ ID NO: 144858 - DNA, 709 bp, Homo sapiens
  Payload ID: 8631
  Gene Symbol: KAT5
  Gene Name: K(lysine) acetyltransferase 5
  ENST ID: ENST00000533596
  CDS Start-End: 1-287
gggctgaagtcggagagcggggagaggccacagatcaccatcaagtgagcctggcgctgtctacctggggtgagattagtgaaatcaccagcatcaagaaggaggatgtcatctccactctgcagtacctcaatctcatcaactactacaagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgcc

SEQ ID NO: 144859 - DNA, 576 bp, Homo sapiens
  Payload ID: 8631
  Gene Symbol: KAT5
  Gene Name: K(lysine) acetyltransferase 5
  ENST ID: ENST00000534104
  CDS Start-End: 529-576
agtggcagtggagggagggaagatggcggaggtgccgaccctggcgtcgcgctgtctccccagggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacc

SEQ ID NO: 144860 - DNA, 609 bp, Homo sapiens
  Payload ID: 8631
  Gene Symbol: KAT5
  Gene Name: K(lysine) acetyltransferase 5
  ENST ID: ENST00000528198
  CDS Start-End: 42-609
agtcaactgaaatcccgggatggggaggggcgtctggaattatggggcgggcgaggcgcagatactttgatgaaggggcgtggctcttagctgctccgagagccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttct

SEQ ID NO: 144861 - DNA, 845 bp, Homo sapiens
  Payload ID: 8631
  Gene Symbol: KAT5
  Gene Name: K(lysine) acetyltransferase 5
  ENST ID: ENST00000531880
  CDS Start-End: 38-845
aactgaaatcccgggatggggaggggcgtctggaattatggggcgggcgaggcgcagatactttgatgaaggggcgtggctcttagctgctccgagagccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagaggtgccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccccagaatggagccgcccgtagggcagtggcagcccagccaggacggaagcgaaaatcgaattgtttgggcactgatgaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtc

SEQ ID NO: 144862 - DNA, 499 bp, Homo sapiens
  Payload ID: 8631
  Gene Symbol: KAT5
  Gene Name: K(lysine) acetyltransferase 5
  ENST ID: ENST00000530605
  CDS Start-End: 1-499
gggggagataatcgagggctgccgcctacccgtgctgcggcggaaccaggacaacgaagatgagtggcccctggccgagatcctgagcgtgaaggacatcagtggccggaagcttttctacgtccattacattgacttcaacaaacgtctggatgaatgggtgacgcatgagcggctggacctaaagaagatccagttccccaagaaagaggccaagacccccactaagaacggacttcctgggtcccgtcctggctctccagagagagagccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacgaaacggaaggtggaggtggtttcaccagcaactccagtgcccagcgagacagccccggcctcggtttttccc

SEQ ID NO: 144863 - DNA, 9153 bp, Homo sapiens
  Payload ID: 8632
  Gene Symbol: KAT6A
  Gene Name: K(lysine) acetyltransferase 6A
  Uniprot ID: Q92794
  ENST ID: ENST00000265713
  CDS Start-End: 413-6427
actgtctccaagatggcggccgtgtcagtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 144864 - DNA, 9285 bp, Homo sapiens
  Payload ID: 8632
  Gene Symbol: KAT6A
  Gene Name: K(lysine) acetyltransferase 6A
  Uniprot ID: Q92794
  ENST ID: ENST00000396930
  CDS Start-End: 545-6559
actgtctccaagatggcggccgtgtcagtttggggcatctccgcggtccggcccggggccccgggatctcggctgtccttcctcccggattctttctactaatccagatacttgttgaagtgctgactagtttcttggggaaagatgtcaaggaagagttgaaattcctagactggtgagcagagattgcggagtacagaatagccatcacccactctggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 144865 - DNA, 9241 bp, Homo sapiens
  Payload ID: 8632
  Gene Symbol: KAT6A
  Gene Name: K(lysine) acetyltransferase 6A
  Uniprot ID: Q92794
  ENST ID: ENST00000406337
  CDS Start-End: 501-6515
actgtctccaagatggcggccgtgtcagtttggggcatctccgcggtccggcccggggccccgggatctcggctgtccttcctcccggattctttctactaatccagatacttgttgaagtgctgactagtttcttggggaaagatgtcaaggaagagttgaaattcctagactggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 144866 - DNA, 588 bp, Homo sapiens
  Payload ID: 8632
  Gene Symbol: KAT6A
  Gene Name: K(lysine) acetyltransferase 6A
  ENST ID: ENST00000426524
  CDS Start-End: 548-588
ctcactgtctccaagatggcggccgtgtcagtttggggcatctccgcggtccggcccggggccccgggatctcggctgtccttcctcccggattctttctactaatccagatacttgttgaagtgctgactagtttcttggggaaagatgtcaaggaagagttgaaattcctagactggtgagcagagattgcggagtacagaatagccatcacccactctggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggatttt

SEQ ID NO: 144867 - DNA, 3279 bp, Homo sapiens
  Payload ID: 8632
  Gene Symbol: KAT6A
  Gene Name: K(lysine) acetyltransferase 6A
  ENST ID: ENST00000418721
  CDS Start-End: 1094-3279
tttcatctgcagagtgggtatattgttttctactttgaaggatggattgtggggaccaaaggaggtaacgacataaggctcaggtcagagtctagcacaataggtgctccacgaacatgattttctctagtccttaaattcatgctctctctgttgtggagcatgtgaattcattctttcatacctctttcatcatgtaacttttaatccctaatgaatggaattacttactgtagtgtttctgtgggaaaatgttcaaatgccagaaagccatctcttctccccacattcccagcctcacactgataataaaggggtacctccctctctcctcaaaacattgcacccccttggggaatggagagggaagggcaagtgagagcgctccagtggacagatgggggaaggcagcagctctgtgtttacagaaattgttaaattatttacacaattttggtgtccctaccagatccagagttggggatactgcaagaatggccttttttatgttacaaactggaattagatgagtcatttaattgaagcttaagtttttgtagaagagtaatactcttttcatataaactggtggtaataaaagctttattatctagcagtaggcataaagttttcttttggtttagcccaattattagtgtatttaatccacccccttgctaccccctgttagttatcttagattaaaaggtcaattctagcctggaacatacgtcttcttttaaataatttggcatatttaaattaggaggacatgaagtggcagaatttgagttaaacatttaaatatattttgtgcccttgattatattagacacctgctgctttggaaagtcacatgtttagcgaaaacgtactttggttgaaatgttaaaataaaaagacctagcaaaggtaaccttgtagttcagatatgacagtttgattttggctaggactggaatgagtggtttctgtgtagccatttcttcctccctgtgtagagagccttgctgatttctaaatcttcgtaaaaggaaacacccttgctgtggaggcttgctcaggggagctgggagtggaggcgggctcacacatgagcgcatgtgcaggaacgtttcacggtgcaaaggttaaaggcgggtgtgggcagaggggaacctaccacaggtcccattctggacagacgtgcgcagttgtggtgatgtgcaaacagctgtactggaactggatatccactttcacatcgggcatccgcctagaagagcagcgggcagctgatgggaagaccctcaaacaacagacagtgccgcagcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaa

SEQ ID NO: 144868 - DNA, 3592 bp, Homo sapiens
  Payload ID: 8632
  Gene Symbol: KAT6A
  Gene Name: K(lysine) acetyltransferase 6A
  ENST ID: ENST00000485568
  CDS Start-End: 413-2860
actgtctccaagatggcggccgtgtcagtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtaagggcatgaatagtctctatttttgatgacagaagatatatttttgatttcatgagtatttataataatgtattatgatcatctttcacagaaaagtaaattcacattagaatgtcaagagttttatttcagtggtagagatttcaagaagactggacctggtttacttaagtatttttaagccttggacaattaggaggagaccatcaaatttcttataatgtgttacttgtgagaaaaatatttgttaccagggtgccaagaagcagctcagttttaagctggatagtagttgagaaatctgaattgaatccaaatctgacagtttttaaaaatgaaatggaggttgggtgtggtgtttcatgcctgtaatctcagcgctttaggaggcccaggcgggaggattgcttgagattaggagttcaggacaaccagggaaatatagtgagaccccatctctacaaaaaaaacccaacaacaaaatgaaatggagatacattttccttaaatagaatattaagtaactattgtaaacttgtgtatgttttctgatggggcaccaaaacatcctgtggacacacagatctctttagccgttaaagggttgctggtgaactgtagtgcatgtgtcattgtcagtatttttcttcatgtgatgcatacttttatagctcttttttttaagcagtgcttcatcctttcaacaccggtatcctcctttaataaacataaaaaatccca

SEQ ID NO: 144869 - DNA, 8287 bp, Homo sapiens
  Payload ID: 8633
  Gene Symbol: KAT6B
  Gene Name: K(lysine) acetyltransferase 6B
  Uniprot ID: Q8WYB5
  ENST ID: ENST00000287239
  CDS Start-End: 490-6711
gacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatggactgttaaaacgtttgaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttt

SEQ ID NO: 144870 - DNA, 7560 bp, Homo sapiens
  Payload ID: 8633
  Gene Symbol: KAT6B
  Gene Name: K(lysine) acetyltransferase 6B
  Uniprot ID: Q8WYB5
  ENST ID: ENST00000372711
  CDS Start-End: 312-5984
gataatctccatttttgtcatggactgttaaaacgtttgaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacagatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttt

SEQ ID NO: 144871 - DNA, 5892 bp, Homo sapiens
  Payload ID: 8633
  Gene Symbol: KAT6B
  Gene Name: K(lysine) acetyltransferase 6B
  Uniprot ID: Q8WYB5
  ENST ID: ENST00000372714
  CDS Start-End: 403-5748
acaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaa

SEQ ID NO: 144872 - DNA, 7106 bp, Homo sapiens
  Payload ID: 8633
  Gene Symbol: KAT6B
  Gene Name: K(lysine) acetyltransferase 6B
  Uniprot ID: Q8WYB5
  ENST ID: ENST00000372724
  CDS Start-End: 515-5860
agtgtcatgtcggattcatgtcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccagatttgcctgaagacctggataatctccatttttgtcatggactgttaaaacgtttgaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccattttt

SEQ ID NO: 144873 - DNA, 6944 bp, Homo sapiens
  Payload ID: 8633
  Gene Symbol: KAT6B
  Gene Name: K(lysine) acetyltransferase 6B
  Uniprot ID: Q8WYB5
  ENST ID: ENST00000372725
  CDS Start-End: 352-5697
ggcaaaggacgaggcggaggctgaggaaggcagcggggagacccaggctgcagcaacaaagggcagcgagcgattggccgggctgcaggcgaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccagccccgtgctgatcccattccaatatgtagcttctgtttggggactaaagaatcaaatcgtgaaaagaaaccagaagaactcctctcttgtgcagattgtggcagtagtggacacccatcctgtttgaaattttgtcctgaattaacaacaaatgtaaaggccttaaggtggcagtgcatcgaatgcaagacatgcagtgcctgtagagtccaaggcagaaatgctgataatatgcttttttgtgattcctgtgatagaggatttcatatggaatgctgtgacccaccactttccagaatgccaaaagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtctgtaaccagtgatgaaggatccatgaatgcattcacaggaagggggtcacctgatactgaaataaaaataaacatcaaacaagaaagtgcagatgtaaatgtgattggaaacaaggatgtcgttactgaagaggatttggatgtttttaagcaggcccaggaactttcttgggagaaaatagagtgtgagagtggggtggaagactgtggccggtacccttctgtgattgaatttggtaaatatgaaatccaaacctggtactcctcgccttacccacaggaatatgcaagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggaaaagctttgccagcagaagtataatgtctcctgcataatgatcatgccccagcaccaaaggcaaggatttggacggtttctcattgatttcagctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaaacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccattttta

SEQ ID NO: 144874 - DNA, 5892 bp, Homo sapiens; identical to SEQ ID NO: 144871
  Payload ID: 8633
  Gene Symbol: KAT6B
  Gene Name: K(lysine) acetyltransferase 6B
  ENST ID: ENST00000628038
  CDS Start-End: 403-5748

SEQ ID NO: 144875 - DNA, 8287 bp, Homo sapiens; identical to SEQ ID NO: 144869
  Payload ID: 8633
  Gene Symbol: KAT6B
  Gene Name: K(lysine) acetyltransferase 6B
  ENST ID: ENST00000630001
  CDS Start-End: 490-6711

SEQ ID NO: 144876 - DNA, 7560 bp, Homo sapiens; identical to SEQ ID NO: 144870
  Payload ID: 8633
  Gene Symbol: KAT6B
  Gene Name: K(lysine) acetyltransferase 6B
  ENST ID: ENST00000629879
  CDS Start-End: 312-5984

SEQ ID NO: 144877 - DNA, 6944 bp, Homo sapiens; identical to SEQ ID NO: 144873
  Payload ID: 8633
  Gene Symbol: KAT6B
  Gene Name: K(lysine) acetyltransferase 6B
  ENST ID: ENST00000629233
  CDS Start-End: 352-5697

SEQ ID NO: 144878 - DNA, 7106 bp, Homo sapiens; identical to SEQ ID NO: 144872
  Payload ID: 8633
  Gene Symbol: KAT6B
  Gene Name: K(lysine) acetyltransferase 6B
  ENST ID: ENST00000628523
  CDS Start-End: 515-5860

SEQ ID NO: 144879 - DNA, 9644 bp, Homo sapiens
  Payload ID: 8634
  Gene Symbol: KAT7
  Gene Name: K(lysine) acetyltransferase 7
  Uniprot ID: O95251
  ENST ID: ENST00000259021
  CDS Start-End: 281-2116
aaaatggcgcccactagcttcaccaaaaggatcgaacttcccagcaccctctctggcccgtaacgtcaggtgacgcgagacccagccggaagtgaaggaaaaagcgcttcagcccgcggcgcctgcgcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaagtctgtttcatctgggggctctcatttatatatgaaaatgatgcacacgatctgctactaatagtaaatgcacttgggatttgctttccctagcagtaaactgttgagggatgtggtttgtggctatggaatgtttttccctgtgatacaggctgtctgtaaagatcaagggagtgctcactctgaacttctctagatggtggcacaaatttgatctgcctcactttggttccagctaatcagtatacgtagcaatgattagtcagtattacccattctttcactaagtgccattttccactgattttaggggcaaaggaaccaataggaaattaggatatatgggggtacagttgatgcctgtaggagatgggaacagacattccttctcatctccaagctcattcaccagtattgagcagtgtcacctctaattattgactctctcgcaggttgaaattattctttttgaaaatagctgcattttcatgtaagatatacccagcacaggaaaagggtggctgagcactaacctccgtatggtggaaaggaggaggctgggaattgtatgtgctggaatggtttcactcactgtgaccagtagtggtgagaacccatacagttgaagttttttgcacagtcctgatcccaggtctccactcgctttgccatcccactttactccctaaaaataaaaggatttattatctcatttaaacccccacaggtgtggaaacagagtttcacttgccttggcaactttgcatgagactatcccatttcattccgtttttttttttttgagtcagagtctggctctgttgcccaggttggagtgcagtggcgcagttttggctcacaacctctgcctcccgggttcaagtgattcttctgtctcagccttccgaatagctgggattacaggtgcctgtcaccatgcccagctaatttttgtatttttagtagagacagggtttcgtcatgttggtcaggctgatctcgaactcctgacctcaggtgatccgcccaccttggcctcccaaagtgctgggattacaggcgtgagccactgcacccgacctatttttttttttttttttttttttttttttaaaaaaagacagtctcactctatcatccagtccggaatgcagtggcatgatctcagctcactgcaatgtctgcctcctggattccagtgattctcctgcctcagcctctcaagtagctgggattacaggtgcaggccacctggctaatttttgtatgtttagtagagacagggttttgccatgttggccaggccagtctcaaactcttgacctcaagtgatcacccgcctcatcctcccaaagtgctgggattacagccgtgagcctctgcacccagcttttaactccctcttatctgcataacagaagcttagctgcttaagctcctttattagaagagcaaaagtctgaaattattcctgaaacctgctcaatggaagtacctactctattggttgcttcccatatggttgtcactgtaccttcatactgcctcatttgaccctcatattagccctgtacagtagatgggtacactggtttgccaaaggagacctggaatccaaggtggaagtaagcagcaaagccagaaacttcaattctggtctgtctaccttgatagcctgcaccctcccctctaccgttttcttccactatttttgattccttaatgatgaatcatcctctcccttctagttggatttgtttctaatggcttccattacaaggataataatgaaactggtgaaaactttcaggcaaaaggattttctttttatattttttcttattattttttaattattaaccaaattaactcattacagtaaaaaggactgatttttaagccagctgtgatagctctgtaatagtctgtaatctcagcactttgggaggccaaggcgggcagatcgcttgagtccaggaattcgagactagcctgggcagcatggtgaaaccccagctctacaaaaaatagaaaaatcagacgtgggcacatgcctgtagtctcagctacttgggaggctgaggcacgagaatcgcctgaacctgggaggcagaagttgcaatgagctgagatgatgccactgcactccagcctgggtgacagagtgagaccctgtctcaaaaacaaaaaacagaattgattgatgttagttggctttagaagcagcaagtttagggggctacagagctaaaccaggaagcaaaagatgtgcctcattctggcattgtttctgatttaggaataaactgttcagtaagcactgtccctttacttccatggttttcttcattcctcaccacagcacagtaaggtggatattatagtcttcttctagatgaaaaattgaggctcatagtggtcttgctgctgtgtcatagcaatagaatgagagagccttgcttccctgagtccaaatcccatacttttggcattgttatgaggtctggtcacctgatgcttccatgctattttcccatttcttatctggggataatgagtcatattaagtaatttttttttttgagacggagtttcgttctgtcacccaggctggagtgcagtggtgcgatcttggctcactgcaagctctgcctcccgggttcatgccattcttctgcttcagtctcccgagtagctgggactacaggtgcccaccaccacgcccagctaattttttgtatttttagtagaatgaggtttcaccgtgttagccaggatgatctcgatctcctgacctcgtgatccactcgcctcagcctcccaaagtgctgggattacaggcgtgagccattgcacccagccattttttttttttttaagacgacgtctcactctgtcacctatgctggagtgcagtggcgtgatctaggctcattgcaacctctgcctcccaggttcaagcgattttcctgcctcagcctcccaagtagctgggattacaggtgcccaccacctcgcctggctaatttttgtatttttagtagagatgaggttttgccctgttggctaggttggtcttgaactcctgacctcaggtgatccactcacctcagcctcccaaagtgctgggattacaggcaggagccactgcgcccagccaagtaacttttaacagtgtggtataacctttaaatgacaaggtgatgcttttgacttgtcctcaactttgatttgtactgatttgtccctatagttctgggtggggtgggtcaaaacaaagtctcgagctgtaccaggatcaagcagcacagctcagccatgatccttttaccacttttttcttctgtccttgagactctaattaaagcactggatttttaaaaatcacccttgtaaatatgcacacatttgtctatagttgaggaaattgtgccgttgaagtccattcttggacatggagttaagaaaccctggtttgagaaaaagccccagtgagacagcaggaatccttttaccatacaaccctcaactagtttagtgtgctcaagctcaaataaccaatcccatcaagtgaaaagaatggcagcagggagaaggcctggctcactgaggctctcagcattagtttcctctacctcttgtgtctcacaggtgcacatatgtacagcatatcaaagtgttgaatgtcatgagaataaaatatgaaaactactttgctgaatgatagtatgtgatgtgtgctaggacttctagaagccaccctttgctttgctgttcattgggatcatggaatcggacctcagctggttttgcctcagcactttctttcacaaaattatgtgtgactgcctcctccagactgtttcctgctgataggggcagtttaatagccttcttcctgtgtggtatctgcaacaaaatcccaatgaatgtcaccaagaaggaaacaaaggattgcccagcgatgagaaatgtccctggtgccaaaacatcagtttgcccctaacctcttgtgcaatacctttaagtccaggtcatgttgttaccatttgggggtttgcggatttgtttacttgtgcccaagaatggagaaaataacctgtactattgtacaactctggctccatggctcctcacaaatgttccatgtgagatataaacatctttatcctcgacaagtcatgttcattccaagaaaccagtctttgttcttaattggacatttgtttctgcaaacagcttaccatacattcaattccaaagttatcagaaacctacactcttatctcacaaatttagaggtgtggtagatcatctccaaagatggccaccaacagttgctctcatcctctgtgcacgtgctatttccaataaggtctatttttttctacagtgagggctgaacttgtgacttgttttgactaataggatatggaagtgatattttggcagcttccacttttgctcttgaaaataagctgacacgtttccaaacgagaagcttgggctaaattactgaatggtgagagacgatgcataggagaaccaaggtgctctagtcacagcactaaaagcccagacttgtgtctcttgaaggtttcaaccccgccagactcccagctgaacgcaccctcatgagtggcccttgctggtaccacatgacactaaagacatctagctgagtcctgttaacccagagaattatgagaatactgttttaaccacacgttttggaatggtttgatacatggcaatggagaagtgaaacaaggggacttcggaaactaaagggctggaattcagtttgccttgtaggttgattggaagccagatgtgcctagaggaaggctaccaccttgtgcaattccaggggacactgtttatgttccgtgtaaatggcagcctcagttcacctcatttggttatttatcgtgtcttcgctgtcagtcaaattgcttctgagataactggctggccttggaattcttagccacctccttaagcggatcaggaaaactgaagaatatccttctgtatgtatgtatgtatttattgattgatcgatttatgagacagggtctccttctgtcacccaggctggagtgcagtggtacgatcacggctcactgctgcgtcgccttcccaggctccagctatcctcccacctcaacctccagagtagttgagaccacaggcgtgcactaccacgcccggctacctttttgtattttcagtagagacgaggtttcgccgtgttgcccaggctggttcaagcggagctcaagcaatcagcctgcctcggcctcccaaagtgttgggattacaggcatgagccgctgcgcccaaccttcttctgctgtcgagatactgctcatcacctgcctgctccagaattcatgtggcttctcattgctcaatggattaagttcatgtttatcctggctttcaagtctttccgtaagctgactcaacctacatagctttcatcattcccttacacataacctcaacgtgcaacaggattagtctattattccctttcttgtgtttactgagaaagcctccacttcaacgttccatgaagtgtgttccattaaataccaaagtataggcaaaaagttctgtggtcaaataaatttggaaaacacagagtgtttccaaagttagtatcaggccaggcatggtgggaggatcacttgagcccaggagttcgagaccagcctgggcaacatagggagacccaatccctacaaaaaaattagttgggcatggtggtgtgcacccgtagtgccagctactcaggaggctgaggtaggaggatcacctgagcccaggaagtcaaggctgtggtcagctgagatcccaccagtgtgctccagcctgggtgacagagcaagaccctgtctcaaaaaataaaaaaataaagataatacc

SEQ ID NO: 144880 - DNA, 3469 bp, Homo sapiens
  Payload ID: 8634
  Gene Symbol: KAT7
  Gene Name: K(lysine) acetyltransferase 7
  Uniprot ID: O95251
  ENST ID: ENST00000424009
  CDS Start-End: 130-1875
caggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 144881 - DNA, 3638 bp, Homo sapiens
  Payload ID: 8634
  Gene Symbol: KAT7
  Gene Name: K(lysine) acetyltransferase 7
  ENST ID: ENST00000435742
  CDS Start-End: 767-2044
tcaattcaacaaatgtctattgactactttctgcgcggtggttgctgtggattcagaaattaattagatgtgatccctggcttaagggtgtcacagcccgataggagaaaacagacatgaataatcttagaaggatctagtaagttctcagcttggaggtgtatacaaggtgttgctggaaggaagtgaaggagcagttaagtctgccctggagtacaatgggagatatattggtaaaagccacagagaagagctgagttccaggatcaagccaggaaggaataagtctcacgtcaaggctttaaatatctcgaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 144882 - DNA, 1774 bp, Homo sapiens
  Payload ID: 8634
  Gene Symbol: KAT7
  Gene Name: K(lysine) acetyltransferase 7
  Uniprot ID: O95251
  ENST ID: ENST00000454930
  CDS Start-End: 155-1573
gcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtg

SEQ ID NO: 144883 - DNA, 563 bp, Homo sapiens
  Payload ID: 8634
  Gene Symbol: KAT7
  Gene Name: K(lysine) acetyltransferase 7
  ENST ID: ENST00000506533
  CDS Start-End: 516-563
tttccgagcggggacgctgataggtgcagaggcggggttttggaggcctcgttaccttccagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgc

SEQ ID NO: 144884 - DNA, 1769 bp, Homo sapiens
  Payload ID: 8634
  Gene Symbol: KAT7
  Gene Name: K(lysine) acetyltransferase 7
  Uniprot ID: O95251
  ENST ID: ENST00000510819
  CDS Start-End: 143-1471
agacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaaggacaccttacaggaaaacatgagagacatttctccatctcaggatgcccactgtatcataacctctcagctgacgaatgcaaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactgg

SEQ ID NO: 144885 - DNA, 1774 bp, Homo sapiens
  Payload ID: 8634
  Gene Symbol: KAT7
  Gene Name: K(lysine) acetyltransferase 7
  Uniprot ID: O95251
  ENST ID: ENST00000509773
  CDS Start-End: 154-1659
cagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagaggacaccttacaggaaaacatgagagacatttctccatctcaggatgcccactgtatcataacctctcagctgacgaatgcaaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaag

SEQ ID NO: 144886 - DNA, 1525 bp, Homo sapiens
  Payload ID: 8635
  Gene Symbol: KAT8
  Gene Name: K(lysine) acetyltransferase 8
  Uniprot ID: Q9H7Z6
  ENST ID: ENST00000219797
  CDS Start-End: 19-1395
gtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccactgtctgacctgggcaagctcagctaccgcagctactggtcctgggtgctgctagagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggccctggactttggaggggaaggggaggcc

SEQ ID NO: 144887 - DNA, 1789 bp, Homo sapiens
  Payload ID: 8635
  Gene Symbol: KAT8
  Gene Name: K(lysine) acetyltransferase 8
  Uniprot ID: Q9H7Z6
  ENST ID: ENST00000448516
  CDS Start-End: 19-1422
gtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccactgtctgacctgggcaagctcagctaccgcagctactggtcctgggtgctgctagagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacaggtgggtggggggctgctgtgtgtcgggggcggtgggggagtgtcagtatatggactggtaggagtcaaggcctccttattgctgtcacatgatcccaaaccagtcagaccagctcccaggatggagcccggggcaggcctctcattcctgggcttccctacccctccccagcacagcctgcccttttgttctcacctggaggaggtgaaactggcctgagcccagaggagggcagccaggtgtgagctggcctggcccaggcccagccctgcctcccgccccttctccccacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtg

SEQ ID NO: 144888 - DNA, 1345 bp, Homo sapiens
  Payload ID: 8635
  Gene Symbol: KAT8
  Gene Name: K(lysine) acetyltransferase 8
  ENST ID: ENST00000537402
  CDS Start-End: 1-562
ctatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccactgtctgacctgggcaagctcagctaccgcagctactggtcctgggtgctgctagagatcctgcgggacttccggggcacactgtccatcaaggacctcaggtgagggggcctcccgggccctgggggcaggacttgccctgagatgggccacgatcctgcttcctcataccctgtcaccatcctggccagatcccacaagggcaccaggtctggcatttgctctcatccctttttgcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacaggtgggtggggggctgctgtgtgtcgggggcggtgggggagtgtcagtatatggactggtaggagtcaaggcctccttattgctgtcacatgatcccaaaccagtcagaccagctcccaggatggagcccggggcaggcctctcattcctgggcttccctacccctccccagcacagcctgcccttttgttctcacctggaggaggtgaaactggcctgagcccagaggagggcagccaggtgtgagctggcctggcccaggcccagccctgcctcccgccccttctccccacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggccctggactttggaggggaaggggaggccaaga

SEQ ID NO: 144889 - DNA, 1846 bp, Homo sapiens
  Payload ID: 8635
  Gene Symbol: KAT8
  Gene Name: K(lysine) acetyltransferase 8
  Uniprot ID: Q9H7Z6
  ENST ID: ENST00000543774
  CDS Start-End: 336-1712
gaactcctggcctgaagcgatcctcctgcttggattcctgaagtgcgagattacaggtgtgagccaccatacctcaacactgtattttcaacccgctcttcgttcaatctccaaaggctgcagccacaggtccgcacggaaaaccaggagctccaagactgccgcacactcaacatccaactcgcggggccgcggggacggccacagaagccaatcggctcctgctacatcacagaccccgccctcaaaccttgaggagcccgccccacgcactgctgacccggagccaaaagaactgcgtggcgtccgattctggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccactgtctgacctgggcaagctcagctaccgcagctactggtcctgggtgctgctagagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggccctggactttggaggggaaggggaggccaaga

SEQ ID NO: 144890 - DNA, 6537 bp, Homo sapiens
  Payload ID: 8636
  Gene Symbol: KALRN
  Gene Name: kalirin, RhoGEF kinase
  Uniprot ID: O60229
  ENST ID: ENST00000240874
  CDS Start-End: 158-5149
gtgtgggaggactggtggctgtctttgcaggcaggcatttgcttagagcaggctgtgtgcgagcccagcgtcaagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgagggtcttttcggaatgatggtttgaaagcttctgatgtccttcctatcctaaaggaaaaggtggccttcgtgtctgggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagcttcgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagca

SEQ ID NO: 144891 - DNA, 10888 bp, Homo sapiens
  Payload ID: 8636
  Gene Symbol: KALRN
  Gene Name: kalirin, RhoGEF kinase
  Uniprot ID: O60229
  ENST ID: ENST00000291478
  CDS Start-End: 164-4033
gtggctcccagtaagtcagagctgcggccgcggtgcggggagagcacagcggggagggcgggagccggctctcgggcggcggcgctgaagtttccttcccgccgcgctctcaccccgggctggcgccccgtgccatgcgggagcgctggggcggcggggcaacatgaagggcggcgacagggcttacacccgaggtccctctttggggtggctctttgctaagtgctgctgttgcttcccgtgtagagatgcatactctcattcctcaagcgagaatggaggcaagtccgagtccgtggccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgtcctcctctttgctagcagcccggcaggcttccactgaagtacctactgctgcagaccttgtcaatgcaatagaaaagttggtcaaaaacaagctgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatattgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagcagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagcgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttaataggatagatacccacatacagtataatatatcccattcaggtttcagagttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatccacccttagttttctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttccattggtttcaaagacaacttcctcattcgccctccacctcatcccatccaagattatagattgataaattaatggaaagtataagcaataagactagatagcacttagtatttttgggattaaccaaatatatggaaaccgactccgactgtatttgtttcttaattttcaaatggccctgggtcataaagcctcactccctcagaggtctctcgactaacccctatagtcttcatttggacctttatgtatttacaaacactctatgatacaatacataaaaatttaaaacatacattaaacatggttactaaaatttttcaaaatgtaaaacatatttagtaaaaaaattttagtaaacatgttttcattgtgtttaaaaaatttaaaacatatttactaaaaatccttttagtaaacagtttactaaaaccctttcaataaacatgtcttcattatggtatacagcataaaagaggaaagcctgagccgggcgcggcggctcacgcctgtgatcccagcactttgggaggccgaggcgggtggatcacaaggtcagcagttcgagaccagcctgactaacatggtgaaaccctgtctccactaaaaatacaaaaaaatcatctgggcgtagtggcgggcactcgtaatcccagcgacttgggaggctgaggcaggagaatcgcttgaaaccggaaggcggaggttgccgtgagccgagattgcaccactgcactctagcctgggcaataagagcaaaattctgtctcgaaaaaaaaggaaagcctggcccatagggtttgtcatgggacaaactgtaggctctgaggattcccaatatccataaagtccagcttggcaagttctgttctgtccactgtggatgacctgaatcaagatccccctgctgagccattctgagtttttataacaagttgagtttctgcttgagaaggccagggcccagaacaatggtgtgcagaccacggcaggtgggggacaaggagggtatttttgaaattatgttatgggggcagttgacagaatgttagacagaccccaagctttcatatcagcttttacaacagagttgggaggatccagatgtggggttgcatggaattcccccaagtacacatatttgggaagtgagaagacaggaaaggagggacctagaaatgaaaagtaggatgattttgttaactggagccaaggtacaatcattagactagaatgaacttaatagaggccccaagagaaagggggtatattttatatagtttgataacggagggaaactaacagggaggctccctgtctgcaaagctcctggtccctcccaacagagataagagagtagtcttggttcaagagttctccacagcaagttggaaataacaaggaatcccagatgatgatgatcctggggaatgtactttaggttgctctgagggcaaccgtgcttagggaaaaaggatcaggggccactcttgttcctgttttggcggagagatttattacttggtagtaaagaagagaggagagaagagaaaatggtccatttctatcattatgatggtagttcacagtgggagtgaactttcagctgaaatgggaaaaacaaacaatggtcaaggtcacaagtttcttgcttggcttttattcattgcatagggttttgagctttttgttttgttttgttttgtaagggtgggatacagaaagaatgaaaagatcagggacaacccataataacttttaagaagtattaatataatgatttcctacatcttttacatttgtttcaaattaaatagatatatatccacttacagctgaatgtggtaaaatttttaagaaaaaaatggtaatgttggagatatccttcaggtctctctcagccataaacaatgtaagggggagtagaggaagcagaggagaaagctagcttcactgctttgtggtccacaaagcctttataaatagtagtgcctttcagaggggaggatgggagataaagaagttcattgcatttagatgtactgatattgcagcattttttctttactttaaaatatcttgtaaatgaaaacatctgaatataggggtgggaccaggaatgtttgagtttcaatctcagctattcctgattcatcttttcttacagaaagtctttgtttttccttccccaaatgtccccattggtaaaatgggagttgggggatggggaaggagggaggacattaatcttacaggaatgttgagaaataaccttggtggggacatctataaaatactttgatttttttaagtgctacacactgccagtgctaagaattttattgatagtaactttgaacattccaggttttcaatattcacgtctttagataccaattataaactcatgagattaaattctgtaaattgttttcagttggaagtatcaggtgctctttgtctaaatgttatttggtcttagcctataatttcgatcatttaagagcttgtctaccgaaaagggttaggagagctgatgaagtcttatgtccataagttgttttctccagtatttcttatggcagatgcgaagagtaaaatgcccttgaaagcaactgctaccttccttctcaagctttatgctctggaaaaaaggacagagaagaacccaacaaccactttcttcacttgggagggcagaagtgagaagaaaatatcttctcataccacaatttatttttcacagcctcacaggaatctaagagacaaattaaatgcacaggcaaattaaatgcatagaaatgaattggactgctcatttttggaggacaaaccttgaatctttttttttttttttaggtggttaggtcttttaggagttgcatatttgctatcccataacctccatgattagagcccacgagttaggcattacttttttcttgcctctgtggaagagcatggcaatttagatttgtgagaatatgagggagcaaatatgatataaactaaattttgcattaactaaaactttgtcccatgcatttaatacaggaggaaattattttgtacgtaagaggtctttgtagtagggcaaagttcaaactcaccatgtccttattcagtatggtcaatgaattgtgctggatgagtttcgaggaatgtagaccttcttcctttctctcctgggtcgcacctctgtggagtctgggttagacaaatgcaatatgtgacctttcagtgaatttatttataaaactgcaccttgatttttcctcactatttaaagcctagggatgatttgatgatgaatgattaaacccatggtgggcttagagacgacagagctcacacacgctccatcaagaaaaggaaagctactatgttaatatttattttctaaaaatattaaggctctcagttgtttcattaattctaaagggttaaaaagggctgaaatttgtttatagcactaaatgtttttaataggaaatttactcacataaaaaatttaagcagaagtagtagaatacagattatcataaaacatattttctatgaaaggcatttcttcctcatcttcaataaatatgaagaagttagaggagaggaaaaagcaatcactctaagacaacttttcgtctttgagggacattatgataagcctgaaattaatacgcacaggctattgcatttttctgtgagaaatgtgcccctttgctgtgagattctaaaatgtgttcagatttagtttttattcaaatgatcaagataacgcattagttagataactgctatttcagatagtgaggttagctgagaaaaggaagcatggtagaagaaatgcaaataacaattcttggaatgccaactcctgaggcttagtttaaccaagctaatttgttggcccagggatggccatcatatgagtttccatcaatacctgacttccatcaacaactgaatccatgttctggagtattacagagactgttactatgacctcaaagactgtggctacgaatctgaagttaacaagacatacatcttctcttactaacttaagccatatctgtcaactctatgtttgatttttctgaccctggtgcttttacttctgtttctgccaaacttcagcctactctatggggaaggtgagtaaaactagtagttagaacaaatatgaagactgaaaaaaactaaacatactcttcataatgagatcctgttcagagaacagtagtgatcaaagtgcaaactgttggaaaatatggatatatgtacatctgtacatgtatatagtgtataatatgtatgtatatgttattgctcatatgcagaaatctatccatttgcagacagcccaggtgggtcaatgtttctaatggaaaaccatttagggccattcaaaaccattagggctaatttgtggagacgaattctactcattctggaattaatttgctgtcttttgacatccacaaagccaaactaacaaagtgtgaaacataaaggggccatcatttagtttattctgtttatctggacttataactatctttacatttgaactattaatagttgatttgcaaactgtattggcatctcttggttttgagtgacccctgcccccctcaagtcttttgagaatttggagtgggcttcactggccattcagacaaagggccttattcataagtggacaggtttccccatagggaccatcgcacatatacatataagtacatacttccatcaggcttgtaacaattgatttaaaatcactccacagtattgataaatagctctatattttcaaggtgcagaagaattccacagccttaattatttcagtgtcttgctggtctgccttaagtgtatcttctgggtttttggttattttattatttttaaatttttctgctgttgttcattttgtatgcacacaatgtcgttttgtaaaggtaggttgtaaatattttatttgtaagtcaaaatcactcatgtgtaatgttgtaaagtgatgacctgctgtcttgttactgctacagtaaatgttataagttatggatgaaacttcaaaatgtacatctcacatgttatgcattcctataaatatactatactaaagatacta

SEQ ID NO: 144892 - DNA, 10586 bp, Homo sapiens
  Payload ID: 8636
  Gene Symbol: KALRN
  Gene Name: kalirin, RhoGEF kinase
  ENST ID: ENST00000354186
  CDS Start-End: 1-8867
ggtcttttcggaatgatggtttgaaagcttctgatgtccttcctatcctaaaggaaaaggtggccttcgtgtctgggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagcttcgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaagctctctggtggatgtgagctgacagtggtcctccaggacttcagtgcgggccacagcagtgagctgaccatccaggtggggcagacggtagagctgctggagcggcccagcgagcggcctggttggtgtctggtccgtaccaccgaacggagcccgcccttggagggtctggtccccagcagcgccctgtgcatctcacactcccgaagcagcgtggagatggactgcttcttccccttggtgaaagatgcatactctcattcctcaagcgagaatggaggcaagtccgagtccgtggccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgtcctcctctttgctagcagcccggcaggcttccactgaagtacctactgctgcagaccttgtcaatgcaatagaaaagttggtcaaaaacaagctgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatattgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagcagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagcgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttaataggatagatacccacatacagtataatatatcccattcaggtttcagagttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatccacccttagttttctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttcca

SEQ ID NO: 144893 - DNA, 10806 bp, Homo sapiens
  Payload ID: 8636
  Gene Symbol: KALRN
  Gene Name: kalirin, RhoGEF kinase
  ENST ID: ENST00000360013
  CDS Start-End: 128-9088
gcaggcatttgcttagagcaggctgtgtgcgagcccagcgtcaagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgagggtcttttcggaatgatggtttgaaagcttctgatgtccttcctatcctaaaggaaaaggtggccttcgtgtctgggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagcttcgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagtccctctttcatgccacttccttgcagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaagctctctggtggatgtgagctgacagtggtcctccaggacttcagtgcgggccacagcagtgagctgaccatccaggtggggcagacggtagagctgctggagcggcccagcgagcggcctggttggtgtctggtccgtaccaccgaacggagcccgcccttggagggtctggtccccagcagcgccctgtgcatctcacactcccgaagcagcgtggagatggactgcttcttccccttggtgaaagatgcatactctcattcctcaagcgagaatggaggcaagtccgagtccgtggccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgtcctcctctttgctagcagcccggcaggcttccactgaagtacctactgctgcagaccttgtcaatgcaatagaaaagttggtcaaaaacaagctgagtctagaaggaagctcataccgggggagcttgaaagaccctgcaggctgcctgaatgaggggatggccccacccacacctcctaaaaacccagaagaagaacagaaagccaaggccctgagaggcaggatgtttgtcctgaatgagctggtacagacagagaaagactatgtcaaggatctgggcattgtggtggagggcttcatgaagagaatagaagaaaagggtgtccctgaggatatgcgaggaaaggacaaaatcgtgtttggaaatattcatcagatttatgactggcataaggattttttcctggcggaactggaaaagtgtatccaggagcaagacagattggcacagctctttattaagcacgagcggaagctgcacatctacgtgtggtattgtcagaataagccgcgctcagagtacatcgttgctgagtatgacgcctactttgaggaggtaaaacaggagataaatcagaggctgacactgagtgacttcctcatcaagcccattcagagaataacaaaataccagttgctcctcaaggacttcctgagatacagtgagaaggctggtttggagtgttcagatattgagaaagcagtggagttaatgtgccttgttcccaaacgctgcaatgacatgatgaatctaggacgtctgcagggctttgagggcactctgactgctcaggggaagctgctgcagcaggacacattctatgtgatcgagctggatgcaggcatgcagtcccggaccaaagagaggcgcgtgttcctcttcgagcagattgtcatcttcagtgaactgctcaggaagggatccctcacccctggctacatgttcaaaaggagcatcaagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatgcactgcaatcgcccattgagtatcaacggaaagaaaggagcacagctgtgatgaggtctcaacctgccaggcttccccaagccagccccaggccctactcctctgttcctgcgggctcagagaagcccccaaagggctccagctataacccacctctgcctcccctgaagatatctacctccaatggcagtccagggtttgaataccaccagcctggggacaagttcgaagccagcaagcagaacgacctgggaggctgcaatgggacctcgtccatggccgtgatcaaagattactatgcactgaaggagaatgaaatctgtgtgagccaaggtgaggtggtccaggtcctcgccgtcaaccagcagaacatgtgtctggtgtaccagcctgccagcgaccattcccccgccgccgagggctgggtcccaggcagcatcctggcgcccctcaccaaagccacagcagcagaaagtagtgacgggagcatcaagaagtcatgttcatggcatactctacgcatgagaaagcgggcggaagtggagaacacgggtaaaaatgaagccacagggcctcgtaaacccaaggatattctgggcaacaaagtctctgttaaagagacgaacagttccgaggaatcagagtgtgatgatcttgaccctaatactagcatggagatcttaaatccaaatttcatccaagaagtggccccagaattccttgtgcccttggtggatgtgacctgcttgcttggggacacagtgatactgcagtgcaaagtctgtgggcggccaaagcccaccatcacttggaagggtccagaccagaacatccttgacactgataacagctcagccacatacacggtctcctcttgtgattctggagaaatcaccctgaagatctgtaatctgatgccccaagacagtgggatttatacctgcatagcaacaaatgaccacgggaccacatcaacgtctgcaacagtcaaagtgcaaggtgttccagcagcccctaaccgccccattgcccaggagagaagctgcacctccgtgattctccgctggctgcccccctccagcacaggaaactgcactatttctggttacactgtggagtacagagaggaaggttctcagatctggcagcagtcagtggcttcgaccttggacacttacctcgtcatcgaagaccttagtcccgggtgtccttatcagttcagagtcagtgccagtaacccctggggaatcagccttcccagcgagccctcggagtttgtgcgacttccagaatatgatgctgctgctgatggtgccaccatttcttggaaggaaaattttgactcagcttacactgagctgaatgaaattggaagaggccgtttctctatagtaaagaaatgcattcacaaagctacccgcaaagatgtggctgtgaaatttgttagcaaaaaaatgaagaagaaagaacaggctgcccacgaggctgccctgcttcagcacctacagcacccccagtacatcactctccatgacacctatgagtcccccacatcctacatcctgatcttggaactgatggatgatggccggctcttagactaccttatgaatcatgatgaactgatggaggaaaaagtagctttctatatccgagacatcatggaggctctgcagtaccttcacaactgcagggttgcacatttggacataaagcctgaaaacctgctcattgacctacggattccagtgcctcgagtgaagctcattgacttggaggatgctgtccagatctcgggtcacttccacattcaccacctgctggggaaccctgagtttgctgccccagaagtcattcaaggcatccccgtctccctggggacagacatctggagcatcggggttctgacatatgtcatgctgagtggggtctcccccttcttggatgagagcaaagaggagacatgtatcaacgtatgcagggtggatttcagcttcccccatgaatacttctgtggtgtgagcaatgctgccagagatttcatcaatgtgatcttacaggaagattttcggaggcggcccacagcagccacatgcttgcagcatccatggctgcagccccataatggcagctactctaagatccccctggacacctcccgcctagcatgcttcatagaacgtcgcaagcaccagaatgatgtgcggcctattcccaatgtcaagagctacattgtcaaccgggtgaaccaagggacgtagccatctcccagcccctatggtttcacatagacgtgcagtgtgaaccaaagcaagactgaatgtgactgtaaataattctgttcatcatttcactccgtgcagttctctgaattgagagatgtacctcttaaacctcgtcagtggttattcagggtctgagcagcagtaaaagtcaccctaaatcaaggggcttttcagaaggtcattctgaagaaataaagaggcaaagggtcacagaagtgttcagaagaagggcaaagataagaacaatattagctgttacgaaattttaactgtatcttccaaaatgagtggttaactgggcaaaccttaagctcacaagagtataaaagatctctggctttgctgaaattttaagcaagaagttctatttaatggagatgtcatgtatatcaactattctggtttagataacttagatatagtttcttaataggatagatacccacatacagtataatatatcccattcaggtttcagagttttctaatatagagatatatatattaaatcaatcacaagtaattttgagtgctccagttaagacagtaatttatttaccgaatcattacattgttttgactaagcacaattagatgacaagtttttttagagcattttatagatcttgtatagaaatcttttaccagaacctgtgcattaagagaaagcaatgttgcccttttgaatgagaaaattttttctgtcaatcgcaggttatttgattaagataggttctttctgtatatgaaacgctccccgcaaattcactggcagctcagaattattctggaaagaaagcctgccaggaaataaattcaaatacagtatgagctgcggggatatttttgtgtctacaccaggtttgaaataagtaaacaaatacaagaggttcatataaaagggcaaatgaaaacctttcctacagttcctatgaacaacgtaccaacactttctgatttcttctacagctgtagaataccatctttcagaaagttggctggctttatttctaactccttattgaagctaaggggtgcttactaaaaggaggcagccatataggccttttaaaggcctggttctaagtcctttttaaagccatggaacaaaacctgatacatcaccctaacagagcattaagttgtaactgagattgcaatacctgtcaccatgcagccgctgatagttctctgaactaaaaggactaattgtactttgaggccaatgctgctttctggtgtatattctccatacaagattattattaactgctctttttccctctggtggaaaaaaaattaaacctgggcatttcatgggttttctttctttatttttgttcatttgttttggagggagggagcttgttttttgtgtttgtacatgatccacccttagttttctagaatgtgtgttgaaaattgcgattatacaagtaagattttaaaaatgtaactcaagtgtttgttcaaatcaggtttaatggtgttgcttctctcctataatgggatagagaaaattaaaatcacgtagtacagaagtgcaagaagagaatttatgaaggatgaatagaactacaaacctatctaaatgaaaaagaaatggtggaaactaagcctgaactttaacatataaaaaacacttattcccacagagaaaatgtaaaattaaaaatcatcatctttttttttcc

SEQ ID NO: 144894 - DNA, 804 bp, Homo sapiens
  Payload ID: 8636
  Gene Symbol: KALRN
  Gene Name: kalirin, RhoGEF kinase
  ENST ID: ENST00000448253
  CDS Start-End: 1-804
gttgcattctatgttgccagtgttcctgctgccagaattggatccaacccattgttccagacaagatcagggcaactagtatggaaaacataacctcaagtatctttgatgtaatctccaagggaaaagttgctccaactttttcttactggtcttttcggaatgatggtttgaaagcttctgatgtccttcctatcctaaaggaaaaggtggccttcgtgtctgggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggccc

SEQ ID NO: 144895 - DNA, 722 bp, Homo sapiens
  Payload ID: 8636
  Gene Symbol: KALRN
  Gene Name: kalirin, RhoGEF kinase
  ENST ID: ENST00000454902
  CDS Start-End: 141-722
gcggccgcggtgcggggagagcacagcggggagggcgggagccggctctcgggcggcggcgctgaagtttccttcccgccgcgctctcaccccgggctggcgccccgtgccatgcgggagcgctggggcggcggggcaacatgaagggcggcgacagggcttacacccgaggtccctctttggggtggctctttgctaagtgctgctgttgcttcccgtgtagagatgcatactctcattcctcaagcgagaatggaggcaagtccgagtccgtggccaacctgcaggcccagccctccctgaactccatccacagttccccgggtcccaagcgctccaccaacactcttaagaagtggctgacgagtcctgtgcgtcggcttaacagcgggaaggcagatggaaacatcaaaaagcagaagaaagttcgcgatggtcggaagagctttgacctgggatctcccaagcctggggatgaaacaacccctcagggagacagcgctgatgagaagagcaagaaaggttggggtgaagatgagccggatgaagagtcacacacacccctcccaccacctatgaagatttttgacaacgaccctacacaggatgaaatgagtctagaaggaagctcataccgggggagcttgaaagaccctgcaggctgcctgaatgaggggatggccccacccacacctcctaaaaacccagaagaagaacagaaa

SEQ ID NO: 144896 - DNA, 810 bp, Homo sapiens
  Payload ID: 8636
  Gene Symbol: KALRN
  Gene Name: kalirin, RhoGEF kinase
  ENST ID: ENST00000439170
  CDS Start-End: 1-648
tggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccaggtcagcatgggcagagctttccagtgggaaatgcctcgggctagacgtgagataagtcctgtcccagtcttgactcagcaaaatcttgctttgtggtcttgtgtgagcttcggtttctttatctgtaagatgtaaaaatgcctgcaccatactcaacttgaatctagaataaaatagtaaatggaaaagctttaatgtttcaaagaattatttatca

SEQ ID NO: 144897 - DNA, 6509 bp, Homo sapiens
  Payload ID: 8636
  Gene Symbol: KALRN
  Gene Name: kalirin, RhoGEF kinase
  ENST ID: ENST00000460856
  CDS Start-End: 158-5122
gtgtgggaggactggtggctgtctttgcaggcaggcatttgcttagagcaggctgtgtgcgagcccagcgtcaagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgagggtcttttcggaatgatggtttgaaagcttctgatgtccttcctatcctaaaggaaaaggtggccttcgtgtctgggggtcgtgataagcgaggcggacccatcctgaccttccctgctcgcagcaatcatgacagaataagacaggaagacctgcggaaactcgtgacgtatttggccagcgtgccaagtgaggacgtgtgcaaacgtggcttcactgtcatcatcgacatgcggggctccaagtgggacctcatcaagcccctcctcaaaacgctgcaggaagcctttccagctgagatccatgtggccctcatcattaaacccgacaacttctggcagaaacagaagaccaactttggcagctccaaattcatctttgagacgagcatggtatctgtggagggcctcacaaagctggtggacccctcccagctgacggaggagtttgatggctccctggactacaaccatgaggagtggatcgaactgcggctctccctggaggagttcttcaacagcgccgtgcacctgctctcgcgcctcgaggacctccaggagatgctagcccggaaggagtttcctgtggatgtggagggctctcggcggctcattgacgaacacacacagctcaagaaaaaggtgctgaaggcccctgtggaggagctggaccgggaggggcagcggctgctgcagtgcatccgctgcagcgacggcttctcaggacgcaactgcatcccgggcagtgctgacttccagagcctggtgcccaagatcaccagtctcctggacaagctgcactccacccggcagcacctgcaccagatgtggcatgtgcgcaagctcaagctggaccagtgctttcagctgcggctcttcgagcaggatgctgagaagatgtttgactggataagccacaacaaggagttattcctccagagccacacggagatcggagtcagctaccagtacgcccttgacctccagacgcagcacaatcactttgccatgaactccatgaatgcctatgtcaacatcaaccgcatcatgtccgtggcttcccgcctctctgaggccggtcattatgcctcacaacaaatcaagcagatctccacccagctggaccaggagtggaagagcttcgctgctgccctggatgaacgcagcaccatcctcgccatgtctgctgtgttccaccagaaggctgagcagttcctgtcgggagtggatgcctggtgcaagatgtgcagtgaaggtggtctgccatccgagatgcaagacctagagctggcaatccaccaccaccagaccttgtatgagcaggtgacccaagcctacacagaggtcagccaggatggcaaagcactacttgatgtgctgcagcggcccctgagccctgggaactccgaatccctcacggccacagccaactactccaaggcagtgcaccaggtgctggacgtggtgcatgaggtgttacatcaccagcgacggctggagagcatctggcagcaccgcaaggtgcggctccaccagcggctgcagctctgcgtcttccagcaggatgtacagcaggtgttggactggattgaaaaccatggtgaggcctttctcagcaaacacactggagttgggaagtccctacatcgagcccgggccctgcagaagaggcatgatgactttgaagaggtggctcagaatacgtacaccaatgcggacaagctcctagaagcagcagagcagttggctcagacgggggaatgtgaccccgaggagatctacaaggcagctcgacacctggaggtgcgcatccaagacttcgtgcgcagggtggagcagcggaagcttctcctggacatgtctgtttccttccacacacacaccaaagagttgtggacatggatggaagaccttcagaaggagatgttggaggatgtctgtgcagattctgtggatgcagtccaggaactgatcaagcagttccagcagcagcagaccgccactctagatgccacactcaatgtcatcaaggaaggcgaagaccttatccagcagctcaggtcagcgcctccctccctcggggagcccagcgaggccagggactcggctgtgtccaacaacaaaacaccccacagcagctccatcagccacatcgagtcggtcctgcagcagcttgatgatgcccaggtgcagatggaggagctgttccacgagcggaagatcaagctggacatcttcctgcaactgcgcatctttgagcagtacaccatcgaggtgacagcagagctagacgcctggaatgaagacttgcttcggcagatgaatgacttcaacacagaggacctaaccctggcagaacagcggctgcagcgccacacagaacggaagctagccatgaacaacatgacctttgaggttatccagcagggacaggatctgcaccagtacatcacggaggtccaggcatcaggaattgagttgatctgtgaaaaagacattgatctggcagcccaggtgcaagagttattggaatttctccatgagaagcagcatgaattggagctcaatgcagagcagactcataagcggctagagcagtgcctccaattacgtcacctccaggctgaagtcaaacaggttctgggatggatccgcaatggagagtcaatgctcaacgccagcctggtcaatgccagctctttgtcggaagcagagcagctgcagcgggagcacgagcagttccaactggccatcgagaagacgcaccagagtgccctgcaggtacagcagaaagccgaggtgctgctccaggccggccactacgatgccgatgccatccgggaatgtgctgagaaggtggccctccactggcagcagctcatgctgaagatggaagaccggctaaaattggtcaatgcctctgtggccttttacaaaacttctgaacaggtgtgtagtgtcctggagagcttagagcaagaataccggagagatgaggactggtgtggtggacgagataagctggggccagcagcagagatcgaccatgtcattcccctcatcagcaaacatttggaacaaaaggaggcctttcttaaggcctgcaccctggctcggcggaatgctgaggtgtttctcaagtacatccacaggaacaacgtcagcatgcccagtgtcgccagccacactcggggacccgagcaacaagtgaaagccatcctgagtgagctcctgcagagggagaatcgcgtgctgcatttctggaccttgaagaagcggcggttagaccaatgccagcaatatgtggtgttcgagcgcagcgctaagcaggcgcttgactggatccaagaaacaggtgaattttacctctcaacacatacctccactggagagaccacagaggagactcaggaactgctgaaagaatatggggaattcagggtgcctgccaagcaaacaaaggagaaggtgaagcttctgattcagctggccgatagctttgtggaaaaaggccacattcatgccacggagataaggaaatgggtgaccacggtggacaagcactacagagatttctccctgaggatgggaaagtaccgatactcactggagaaagccctaggagtcaacacagaggataataaggacctggagctggatattatcccagcaagcctttcggatcgggaggtcaagctgcgggacgccaaccacgaagtcaatgaagagaagcggaagtcagcccggaagaaagaatttattatggctgaactactccagacagagaaggcttatgtaagggatttgcatgagtgcttagagacctacctgtgggaaatgaccagtggtgtggaggagatcccccctgggatcctcaataaagagcatatcatctttggcaacatccaagagatctacgatttccataacaacatcttcctcaaagagctggagaagtacgagcaactgcctgaggatgtgggacactgctttgttacctgggcagacaaatttcagatgtatgtcacctactgtaaaaacaagcctgattccaaccagcttatcctggagcatgcgggcaccttctttgatgagatacaacagcggcatggtctggccaactccatctcttcctacctaattaagcctgtccaaaggatcaccaaatatcaactgctcctgaaggaacttttaacttgctgtgaagaagggaaaggggagctcaaggatggcctggaggtgatgctcagtgtcccaaagaaagccaatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcaggacacacgaaatatgtttacaagaacaagctactgacctcagagctgggtgtgaccgagcacgtggagggcgatccctgcaaattcgccttgtggtctgggcgcaccccatcctcagacaataaaacagtgctgaaagcctccaacattgaaaccaagcaggagtggatcaagaacattcgagaagtgattcaagaaaggatcattcacctgaaaggagctttaaaggagccacttcagctccccaaaacaccagccaaacagaggaacaatagtaagagggatggagtggaggatattgacagccagggggatgggagcagccaaccagacaccatctccattgcttctaggacctctcagaacacagtggacagtgacaaggatggcaaccttgttcctcggtggcacctgggacctggagatcctttctccacttacgtttagcgcgcatcctgggacttgtccctgcagctcaccgggttagccgtggcaccgttgggacctcccaccaggactccaatcacccacctctcttgagacttctctggcagggctggtgtggggtgcagcctttgctcagagggcaacatgttccaagcaaaatctccccgcctgggccatgggctcaccctcggggctcccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggctgggttatgggggagggcagggtaaagggatccttaaaaaagtttacacttctatgtatctcacaatcttattgtgaggatgtgacttgttcagtgttctgaacttttcgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattctaaagc

SEQ ID NO: 144898 - DNA, 2620 bp, Homo sapiens
  Payload ID: 8636
  Gene Symbol: KALRN
  Gene Name: kalirin, RhoGEF kinase
  ENST ID: ENST00000483658
  CDS Start-End: 86-247
aagtgattccggcctcctcgagtcagcggtggtgggatgaggctctgccgaggggactggctgtgaaggatgagttcagggtgggatgacggaccgcttctgggaccagtggtatctctggtatctccgcttgctccggctgctggatcgagttccatctatgttgctgcaaatgacaggatttcctttttataggttgtctcttcactctgttgattgtttcccttgctgtgcagaagctttttagtttcaacaagggtgccaagaacatatattgggaaaaggacatccttttcaataagtggtgctgggaaaatgggatatctatattcagaagaatgaaattagacccctatctctcaccctatacaaaaatcagctcaaaatggattaaagacttacgtgttagaagacaggtcccagtcttcctaatgaggcattgaaagtctaggtggaatagatgcttgctggagcctgtggatattataaaagaaagagctcactgccttaatgtggtcaggagaggcaggagtgagagccagtgtgaaggtgtgggagttggaaggaacttggaactcaacttcttttggcccctcaacttgagattcacaaagaaaaaaagcaatgtctcctcgctgaaagcaaaatggaagctcctccttgcacagtgcagccccttcctcactgtaggttattccaagtgagaagagtaaacatgacttctaaatgccatctaacgatatatgcatatctaaaggagacaaggatgactgaatgcatcttcatgtgtaggaagtgaagtgtctgttgacattaagtacttcttcatgagtgagaggaggcccatgatggagatgacaccagtacctccttctagcactctgaattcccaatgtttactactgctgtctctgaaactgcagcatcctcaccaggaccacacagggaacaaaggcaagacacctgaaatccctttagccatattcacaacacttacttcatagataagatgatgtttgaaatatgagaaggattttttttttaaaagagcactctattctcttggtatcctagtatgagtgcctgaaagtgcacattggctagaaggtttcatgtgagcatcagccccagggtccagaagacactcttggcaagcctggagagtgagtatgttgaacaggcaatggaagcatccatgaaaggcaggcaactgcgcacgactttccaacagatggctggtcagttgcacagagggaaggagccatggattccatgataatgacacttgtgccagcttttgtgtttccagaagttttgaagatataagggaaccaccacatgtagagtatgtgaagtcttacagagacgaggtcctaaggtatttattttgacaaatcacgttgcaagtaatgtgaaagcagtttgaagaaaaaatgtccccatctaatgctgcattatggcatgcatttctttagcctaaatctgtcagtgacatgaaaatacatgttttgctggacacataataggttgaacacataataggttctaacatggatctgcataaagaagaaagaagaaaggctataaaggtagaagaataaatgtataaatattacaacaggacactgagctgagtggctctttaccatagaccttgctcatagttctcactacaggcttgctctgagccaacttccaagttctctccttctccttccaaacttccctgtatgtcatcttgctcctgggccacctgactgatgtttaatgcctggatatttgctttcacctctgcatgaccaagccttggccaagtcactgttgactcagttgcaacatctgtcccctgctgagggctgttgtagctttcatagctcacagtccagcttgaatctaaccttttctgtggtcattcagagtagcaagaagcattgtgttttggatttactgcagaactcacacacttaactgtacacagtcagtttttatagctatcactgcatccagattggacagtgaccttggctgagacatcctttacctctgtttcagattaatttaggcggcatataaaatctctgtgcactgccaggggaaagtaaagacttcatgaagaaatggagaagagccgaatagttgaccattgttgctgtataaatcttggatccagggctaaaaggtggcagtataaatgcagatggtgctgctgccatattttcctggcacacctttaagcagcacatttcaagccttcagggttggaatggcatttccaaatatagactcaaaaaatcctcagatgtttgattctagaatagagctgggaattctgtcctgcaaatgccttctgcagcatgggagcaaacccactcttctgtgtctgttgcttcaaactctctattttctggaaactggagaaagatgtgggtctacattttgaaatatatgccttgaacaagaattatgcacctatagaaaacttgtcatacattgaataaactctcagtttacagaaatctatggaaatatcaaaataaaacatcagaaggagcagtaactatagaggttattaactaaggggataacctgaaaaataaagttatatttgctaaaaactgta

SEQ ID NO: 144899 - DNA, 866 bp, Homo sapiens
  Payload ID: 8637
  Gene Symbol: KLK1
  Gene Name: kallikrein 1
  Uniprot ID: P06870
  ENST ID: ENST00000301420
  CDS Start-End: 37-825
tcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtg

SEQ ID NO: 144900 - DNA, 1854 bp, Homo sapiens
  Payload ID: 8637
  Gene Symbol: KLK1
  Gene Name: kallikrein 1
  ENST ID: ENST00000593325
  CDS Start-End: 40-210
agttcctccacctgctggcccctggacacctctgtcaccatgtggttcctggttctgtgcctcgccctgtccctgggggggactgctctggttttctggaaccccaccccaaggatcctgaatgccttctcagccagcgcttctgccctggcctcccccaagattgcctccaagaggaccccatatccttccagtaccctcagaccatgaaccccatccccatgagaaacgaagatcccatccttcaccctgtccgagaaggactgccactcacgcctccctcctcctgagccccgtcccagtcctgaccgcaactgtgttctcagggccccaacctcccctcagattgccattcctggttcacaggaaggaccccaaaacctctcggaagcccacctctagccttaaccatagccctttcttttaccctttaaccaggaagccctgaaatctaactgtcccagccaagctggccccttccaaccccaatgtagggaccccaagtcacccccaaactcttcagtccagatgctcttctttacctctcagacctggttccctaaagctgcatcctttcctgaacctcaaaagcccaacccaggtcctgtttccctagcctaggagccccttagccctccagattcttcctcagtgagcctctgatcctgtcccacccttggcgccttgatccctggtttccagaatccctttccactcccctaacccaccacctcccatcccccagccccagaccccaaatgacctgacgcccagatgcagtgtctgctccagacactgtctcctgtctcctaccctgatccctggaggctgctctactgtcagagcacaaaatctccccaccaggtccagccaccactccaaaagcccagggaacagtccagagtcccaccccttcccaacaccccttgcccatgtccccaacctccagccctggtcctctacccgcaatgtcccttcagacccacagcccagctccctctcctagccttgtccctggcctctcctgccaaccctgcccttcctgacccagcaccgcctctgcaggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 144901 - DNA, 2363 bp, Homo sapiens
  Payload ID: 8638
  Gene Symbol: KLKB1
  Gene Name: kallikrein B, plasma (Fletcher factor) 1
  Uniprot ID: P03952
  ENST ID: ENST00000264690
  CDS Start-End: 188-2104
ctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatca

SEQ ID NO: 144902 - DNA, 645 bp, Homo sapiens
  Payload ID: 8638
  Gene Symbol: KLKB1
  Gene Name: kallikrein B, plasma (Fletcher factor) 1
  ENST ID: ENST00000428196
  CDS Start-End: 202-645
tggtgggctgtctgttggggtctatgcacaggatttctgctggagttctaaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccag

SEQ ID NO: 144903 - DNA, 569 bp, Homo sapiens
  Payload ID: 8638
  Gene Symbol: KLKB1
  Gene Name: kallikrein B, plasma (Fletcher factor) 1
  ENST ID: ENST00000446598
  CDS Start-End: 147-569
agtgccacattagaacagcttgaagaccgttcatttttaagtgacaagagactcacctccaagaagcaattgtgttttcagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctata

SEQ ID NO: 144904 - DNA, 2175 bp, Homo sapiens
  Payload ID: 8638
  Gene Symbol: KLKB1
  Gene Name: kallikrein B, plasma (Fletcher factor) 1
  ENST ID: ENST00000513864
  CDS Start-End: 255-1799
agaacagcttgaagaccgttcatttttaagtgacaagagactcacctccaagaagcaattgtgttttcagtttcctgtgagggagttttctctgtgtccccacaaggcatgattctgggtctatggtgacttaagagggccacacaacaatgagtatttaattttcctcagatgtatggctacaataaacatctataggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatc

SEQ ID NO: 144905 - DNA, 2317 bp, Homo sapiens
  Payload ID: 8638
  Gene Symbol: KLKB1
  Gene Name: kallikrein B, plasma (Fletcher factor) 1
  ENST ID: ENST00000511608
  CDS Start-End: 1-2060
ttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtataggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagat

SEQ ID NO: 144906 - DNA, 1602 bp, Homo sapiens
  Payload ID: 8639
  Gene Symbol:
  Gene Name: Kallikrein-9  [Source:UniProtKB/Swiss-Prot
  Acc:Q9UKQ9]
  Uniprot ID: Q9UKQ9
  ENST ID: ENST00000250366
  CDS Start-End: 35-787
ggtgcacgttccaggatccaggtgcccaggggtcatgaagctgggactcctctgtgctctgctctctctgctggcagggcatggctgggcagacacccgtgccatcggggccgaggaatgtcgccccaactcccagccttggcaggccggcctcttccaccttactcggctcttctgtggggcgaccctcatcagtgaccgctggctgctcacagctgcccactgccgcaagccgtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactgagcccgcgcgccacgggggcaccttggaagaccaagagaggccgaagggcacggggtagggggttctcgtagggtcccagcctcaatggttcccgccctggacctccagctgccctgactcccctctggacactaagactccgcccctgaggctccgccccctcacgaggtcaagcaagacacagtcgcgccccctcggaacggagcagggacacgcccttcagagcccgtctctatgacgtcaccgacagccatcacctccttcttggaacagcacagcctgtggctccgccccaaggaaccacttacacaaaatagctccgcccctcggaactttgcccagtgggacttcccctcgggactccaccccttgtggccccgcctccttcaccagagatctcgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctcaccttctttctgcctgagctgtgagatgagtggagagcaaacgggtgggcggtgaagggcagatgagggaaccggtaccgccttgcaactcccccttaaacccctaacctcaccatgggacgcccccgacctcgtgcggccaagacgtggatgttcctgctcttgctggggggagcctgggcaggacactccagggcacaggaggacaaggtgctggg

SEQ ID NO: 144907 - DNA, 1388 bp, Homo sapiens
  Payload ID: 8639
  Gene Symbol:
  Gene Name: Kallikrein-9  [Source:UniProtKB/Swiss-Prot
  Acc:Q9UKQ9]
  ENST ID: ENST00000599166
  CDS Start-End: 1-276
gtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactgagcccgcgcgccacgggggcaccttggaagaccaagagaggccgaagggcacggggtagggggttctcgtagggtcccagcctcaatggttcccgccctggacctccagctgccctgactcccctctggacactaagactccgcccctgaggctccgccccctcacgaggtcaagcaagacacagtcgcgccccctcggaacggagcagggacacgcccttcagagcccgtctctatgacgtcaccgacagccatcacctccttcttggaacagcacagcctgtggctccgccccaaggaaccacttacacaaaatagctccgcccctcggaactttgcccagtgggacttcccctcgggactccaccccttgtggccccgcctccttcaccagagatctcgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctcaccttctttctgcctgagctgtgagatgagtggagagcaaacgggtgggcggtgaagggcagatgagggaaccggtaccgccttgcaactcccccttaaacccctaacctcaccatgggacgcccccgacctcgtgcggccaagacgtggatgttcctgctcttgctggggggagcctgggcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaac

SEQ ID NO: 144908 - DNA, 3111 bp, Homo sapiens
  Payload ID: 8640
  Gene Symbol: KLK10
  Gene Name: kallikrein-related peptidase 10
  Uniprot ID: O43240
  ENST ID: ENST00000309958
  CDS Start-End: 220-1050
catcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctccgagctaggctggccctgagtcattagcaccttctctgccttcatgaggccactgaactcaagggacctcaccttgcttctatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttttaatagcacctattatacctgaaattatctca

SEQ ID NO: 144909 - DNA, 1508 bp, Homo sapiens
  Payload ID: 8640
  Gene Symbol: KLK10
  Gene Name: kallikrein-related peptidase 10
  Uniprot ID: O43240
  ENST ID: ENST00000358789
  CDS Start-End: 148-978
ggagaagcttccggactccttggggttaaaagggaaggtcccgccaggggtccctgggcagaggataccagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 144910 - DNA, 3006 bp, Homo sapiens
  Payload ID: 8640
  Gene Symbol: KLK10
  Gene Name: kallikrein-related peptidase 10
  Uniprot ID: O43240
  ENST ID: ENST00000391805
  CDS Start-End: 121-951
acaatctcccttttcaagccagcctctgtccctcctactcaacctgctttatctctaggccttcctccttcctcttccacagtctggcttctcacattgtcactctagcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctccgagctaggctggccctgagtcattagcaccttctctgccttcatgaggccactgaactcaagggacctcaccttgcttctatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttttaatagcacctattatacctgaaatt

SEQ ID NO: 144911 - DNA, 549 bp, Homo sapiens
  Payload ID: 8640
  Gene Symbol: KLK10
  Gene Name: kallikrein-related peptidase 10
  ENST ID: ENST00000599077
  CDS Start-End: 121-549
acaatctcccttttcaagccagcctctgtccctcctactcaacctgctttatctctaggccttcctccttcctcttccacagtctggcttctcacattgtcactctagcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctg

SEQ ID NO: 144912 - DNA, 1428 bp, Homo sapiens
  Payload ID: 8640
  Gene Symbol: KLK10
  Gene Name: kallikrein-related peptidase 10
  ENST ID: ENST00000601467
  CDS Start-End: 600-731
actcaggccctgtccgatttctgccacccggatcctcgctcttccgtggactcttcgccgcgttctttctcctcctcttacgccgccccatcccggccccgctccattttacactaccgtgttttgttttgtttgtttgtttgtttgagacggagtctcgctctgtcgcccaggctggagtgcagtgacgcgatctcggctcactgcaagctccgcctcccgggttcacaccattctcctgcctcagcctcccgagtagctgggactacaggcgcccgccaccaagcccggctagttttttgtatttttagtagagatgggatttcaccgtggtctcgatctcctggcctcgtgatccgcctgcctcggcctcccaaagtgctgggattacaagcccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttact

SEQ ID NO: 144913 - DNA, 1198 bp, Homo sapiens
  Payload ID: 8641
  Gene Symbol: KLK11
  Gene Name: kallikrein-related peptidase 11
  Uniprot ID: Q9UBX7
  ENST ID: ENST00000319720
  CDS Start-End: 132-884
agggtggagtgcaggcttggaaagcaggagagctcagcctacgtctttaatcctcctgcccaccccttggattctgtctccactgggactcaagagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaa

SEQ ID NO: 144914 - DNA, 1268 bp, Homo sapiens
  Payload ID: 8641
  Gene Symbol: KLK11
  Gene Name: kallikrein-related peptidase 11
  ENST ID: ENST00000319756
  CDS Start-End: 107-457
tgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccgtggccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatga

SEQ ID NO: 144915 - DNA, 930 bp, Homo sapiens
  Payload ID: 8641
  Gene Symbol: KLK11
  Gene Name: kallikrein-related peptidase 11
  Uniprot ID: Q9UBX7
  ENST ID: ENST00000391804
  CDS Start-End: 47-874
ggactcaagagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccgtgggtgtcactcacctctcccacccatgtctcccccgacctttcctcctccaactactgtctctcccacctcagccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcc

SEQ ID NO: 144916 - DNA, 1174 bp, Homo sapiens
  Payload ID: 8641
  Gene Symbol: KLK11
  Gene Name: kallikrein-related peptidase 11
  Uniprot ID: Q9UBX7
  ENST ID: ENST00000453757
  CDS Start-End: 113-865
cccagcctacctgctgtagctgccgccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatga

SEQ ID NO: 144917 - DNA, 733 bp, Homo sapiens
  Payload ID: 8641
  Gene Symbol: KLK11
  Gene Name: kallikrein-related peptidase 11
  ENST ID: ENST00000593681
  CDS Start-End: 1-424
caacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatga

SEQ ID NO: 144918 - DNA, 608 bp, Homo sapiens
  Payload ID: 8641
  Gene Symbol: KLK11
  Gene Name: kallikrein-related peptidase 11
  ENST ID: ENST00000598799
  CDS Start-End: 97-608
gtgctgtgagaaacaggggatttccccaaccttgtttctcccaagtggggagcgggagcagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagca

SEQ ID NO: 144919 - DNA, 351 bp, Homo sapiens
  Payload ID: 8641
  Gene Symbol: KLK11
  Gene Name: kallikrein-related peptidase 11
  ENST ID: ENST00000601671
  CDS Start-End: 147-351
aacccagcctacctgctgtagctgccgccactgccgtctccgccgccactgggcccccagagccccagccccagagccttgatgcggccccatgtccctccttgttcccagaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctaca

SEQ ID NO: 144920 - DNA, 759 bp, Homo sapiens
  Payload ID: 8641
  Gene Symbol: KLK11
  Gene Name: kallikrein-related peptidase 11
  ENST ID: ENST00000600362
  CDS Start-End: 101-430
gctgtagctgccgccactgccgtctccgccgccactgggcccccagagccccagccccagagcctaggaacctggggcccgctcctcccccctccaggccatgaggattctgcagttaatcctgcttgctctggcaacagtacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatctactgagtgctta

SEQ ID NO: 144921 - DNA, 1347 bp, Homo sapiens
  Payload ID: 8641
  Gene Symbol: KLK11
  Gene Name: kallikrein-related peptidase 11
  Uniprot ID: Q9UBX7
  ENST ID: ENST00000594768
  CDS Start-End: 187-1035
agtcatagtagtaggaagaggaagcacctaggtttgaggccagggctggctgctgtcagaacctaggccctcccctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagttacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtg

SEQ ID NO: 144922 - DNA, 882 bp, Homo sapiens
  Payload ID: 8642
  Gene Symbol: KLK12
  Gene Name: kallikrein-related peptidase 12
  Uniprot ID: Q9UKR0
  ENST ID: ENST00000250351
  CDS Start-End: 118-882
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaactccactcttgttggcctgggaacttcttggaactttaactcctgccagcccttctaa

SEQ ID NO: 144923 - DNA, 1074 bp, Homo sapiens
  Payload ID: 8642
  Gene Symbol: KLK12
  Gene Name: kallikrein-related peptidase 12
  Uniprot ID: Q9UKR0
  ENST ID: ENST00000319590
  CDS Start-End: 118-864
gcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 144924 - DNA, 735 bp, Homo sapiens
  Payload ID: 8642
  Gene Symbol: KLK12
  Gene Name: kallikrein-related peptidase 12
  Uniprot ID: Q9UKR0
  ENST ID: ENST00000529888
  CDS Start-End: 77-412
cgaggacaggccaaacagtgacagccacgtagaggatctggcagacaaagagacaagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagt

SEQ ID NO: 144925 - DNA, 931 bp, Homo sapiens
  Payload ID: 8642
  Gene Symbol: KLK12
  Gene Name: kallikrein-related peptidase 12
  ENST ID: ENST00000530943
  CDS Start-End: 77-316
cgaggacaggccaaacagtgacagccacgtagaggatctggcagacaaagagacaagactttggaagtgacccaccatggggctcagcatctttttgctcctgtgtgttcttggtgagttctcccggagcagggagagggcaggactgcgactggatcccttcacccccatgaggaggccccaccaccctccccatctcagctctggcccccagcctggtggtgaggaggagaggggctttctctgtgcctccatttacctgcagctctcaggggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggg

SEQ ID NO: 144926 - DNA, 1170 bp, Homo sapiens
  Payload ID: 8642
  Gene Symbol: KLK12
  Gene Name: kallikrein-related peptidase 12
  ENST ID: ENST00000526824
  CDS Start-End: 445-684
gggcttgcagaggagagagggagtggggctgggtcttcccaccctgggtcctttcctccttccccactccgtttagctgtaaagctcaattaagtgtgattagctgagaagagtttctgcagaattagagcacgccccacccctgtcttcgtggtccccttcccttaacccggaaactggatgggccaggacaaagagagttaagagctttgtcagtggtctgtctggagcgacagatggaaggaaagggaccggttgagcaacatgacaggtggctgaggagccaggtgcagagtggtagagttggctggcggagtggccagcacatgagaagacaggcaggtaggtggacggagagatagcagcgacgaggacaggccaaacagtgacagccacgtagaggatctggcagacaaagagacaagactttggaagtgacccaccatggggctcagcatctttttgctcctgtgtgttcttggtgagttctcccggagcagggagagggcaggactgcgactggatcccttcacccccatgaggaggccccaccaccctccccatctcagctctggcccccagcctggtggtgaggaggagaggggctttctctgtgcctccatttacctgcagctctcaggggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaactccactcttgttggcctgggaacttcttggaactttaactcctgccagcccttctaagacccacgagcggggtgagagaagtgtgcaatagtctggaataaatataaatgaaggaggg

SEQ ID NO: 144927 - DNA, 962 bp, Homo sapiens
  Payload ID: 8642
  Gene Symbol: KLK12
  Gene Name: kallikrein-related peptidase 12
  ENST ID: ENST00000531374
  CDS Start-End: 77-610
cgaggacaggccaaacagtgacagccacgtagaggatctggcagacaaagagacaagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggagtaaggggcccagggccaggggtcaggggtcaggatgggtacaagtctgggatgcagggcgagaggtcgaatcatgacacctcagaggaaggatggacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaactccactcttgttggcctgggaacttcttggaactttaactcctgccagcccttctaagacccacgagcggggtgagagaagt

SEQ ID NO: 144928 - DNA, 1077 bp, Homo sapiens
  Payload ID: 8642
  Gene Symbol: KLK12
  Gene Name: kallikrein-related peptidase 12
  Uniprot ID: Q9UKR0
  ENST ID: ENST00000525263
  CDS Start-End: 121-867
caagcaggtcatccccttggtgaccttcaaagagaagcagagagggcagaggtggggggcacagggaaagggtgacctctgagattccccttttcccccagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 144929 - DNA, 1047 bp, Homo sapiens
  Payload ID: 8643
  Gene Symbol: KLK13
  Gene Name: kallikrein-related peptidase 13
  ENST ID: ENST00000156476
  CDS Start-End: 44-343
tcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 144930 - DNA, 378 bp, Homo sapiens
  Payload ID: 8643
  Gene Symbol: KLK13
  Gene Name: kallikrein-related peptidase 13
  Uniprot ID: Q9UKR3
  ENST ID: ENST00000335422
  CDS Start-End: 1-378
atgtggcccctggccctagtgatcgcctccctgaccttggccttgtcaggagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataa

SEQ ID NO: 144931 - DNA, 1239 bp, Homo sapiens
  Payload ID: 8643
  Gene Symbol: KLK13
  Gene Name: kallikrein-related peptidase 13
  ENST ID: ENST00000376799
  CDS Start-End: 232-528
cagctcagagctcttcctgcttgtccctgggtgacctggtttcccggctgaggttggccctccgaccccagacccttcacctcccaaaataccctcgcagcagcccctcccgcgttcaaggcttcctgtcctctctggaaagctgaaagacatgggttcgcgtcctgacgctgccgctttgagccagtagcctagcagctgctttgtgcctaaattgttttcatctggaaaatgggcttaatctataagtgcttaccagagaaggtcactgtgaatattgaaacgaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 144932 - DNA, 1614 bp, Homo sapiens
  Payload ID: 8643
  Gene Symbol: KLK13
  Gene Name: kallikrein-related peptidase 13
  ENST ID: ENST00000441527
  CDS Start-End: 44-325
tcaggccccgcccgccctgccctcccctcccgatcccggagccatgtggcccctggccctagtgatcgcctccctgaccttggccttgtcaggaggtgaagacttcaaggagccaagccaggggcctagagatgtaatggcggcttcccgaccagaggccttcccaaagggcttgacccttgagccaagacctgaaaaaggagggatctgtgggtgcctggcacctggcaccatccttggcctgaaggtggggtggcttttctcctctggcgacactccctggattcatgcccgtgccactcctgagtgccacaccctaggctaggagacccacacgctacgccttgtggagtcctcaacaacctggcgaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccagggtatgcacccacacaggtggcctgaggccccataggagtggctggggaaacaggggcagagatgggagggaaggtctgagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 144933 - DNA, 615 bp, Homo sapiens
  Payload ID: 8643
  Gene Symbol: KLK13
  Gene Name: kallikrein-related peptidase 13
  ENST ID: ENST00000595547
  CDS Start-End: 1-615
atgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctgtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataa

SEQ ID NO: 144934 - DNA, 927 bp, Homo sapiens
  Payload ID: 8643
  Gene Symbol: KLK13
  Gene Name: kallikrein-related peptidase 13
  Uniprot ID: Q9UKR3
  ENST ID: ENST00000595793
  CDS Start-End: 44-877
tcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacat

SEQ ID NO: 144935 - DNA, 1530 bp, Homo sapiens
  Payload ID: 8643
  Gene Symbol: KLK13
  Gene Name: kallikrein-related peptidase 13
  ENST ID: ENST00000601975
  CDS Start-End: 232-528
cagctcagagctcttcctgcttgtccctgggtgacctggtttcccggctgaggttggccctccgaccccagacccttcacctcccaaaataccctcgcagcagcccctcccgcgttcaaggcttcctgtcctctctggaaagctgaaagacatgggttcgcgtcctgacgctgccgctttgagccagtagcctagcagctgctttgtgcctaaattgttttcatctggaaaatgggcttaatctataagtgcttaccagagaaggtcactgtgaatattgaaacgaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccagggtatgcacccacacaggtggcctgaggccccataggagtggctggggaaacaggggcagagatgggagggaaggtctgagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 144936 - DNA, 737 bp, Homo sapiens
  Payload ID: 8643
  Gene Symbol: KLK13
  Gene Name: kallikrein-related peptidase 13
  ENST ID: ENST00000596955
  CDS Start-End: 48-590
ctcctcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccagggtatgcacccacacaggtggcctgaggccccataggagtggctggggaaacaggggcagagatgggagggaaggtctgaggtaggttcctttatatataaaaatataaataagtaaataaatatatatatttaaagttagctgtatcctttatataaatataaattcatgaatatataaaaa

SEQ ID NO: 144937 - DNA, 1323 bp, Homo sapiens
  Payload ID: 8643
  Gene Symbol: KLK13
  Gene Name: kallikrein-related peptidase 13
  ENST ID: ENST00000602090
  CDS Start-End: 44-325
tcaggccccgcccgccctgccctcccctcccgatcccggagccatgtggcccctggccctagtgatcgcctccctgaccttggccttgtcaggaggtgaagacttcaaggagccaagccaggggcctagagatgtaatggcggcttcccgaccagaggccttcccaaagggcttgacccttgagccaagacctgaaaaaggagggatctgtgggtgcctggcacctggcaccatccttggcctgaaggtggggtggcttttctcctctggcgacactccctggattcatgcccgtgccactcctgagtgccacaccctaggctaggagacccacacgctacgccttgtggagtcctcaacaacctggcgaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcagtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 144938 - DNA, 1060 bp, Homo sapiens
  Payload ID: 8644
  Gene Symbol: KLK14
  Gene Name: kallikrein-related peptidase 14
  Uniprot ID: Q9P0G3
  ENST ID: ENST00000156499
  CDS Start-End: 220-1023
gcacctagcagatcccaagctggggaatgccagttctggcaccaaccttcctgctccctgctggggcctctgctcccccatctctcaggagtcgaaagtgagaaagcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacgagcagttgcttcaggcgttttctccc

SEQ ID NO: 144939 - DNA, 1133 bp, Homo sapiens
  Payload ID: 8644
  Gene Symbol: KLK14
  Gene Name: kallikrein-related peptidase 14
  Uniprot ID: Q9P0G3
  ENST ID: ENST00000391802
  CDS Start-End: 220-1023
gcacctagcagatcccaagctggggaatgccagttctggcaccaaccttcctgctccctgctggggcctctgctcccccatctctcaggagtcgaaagtgagaaagcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggacctggccctcagcccctaaaatgttcctcctgctgacagcacttcaagtcctggctatagccatgacacagagccaagaggatgagaacaagataattggtggccatacgtgcacccggagctcccagccgtggcaggcggccctgctggcgggtcccaggcgccgcttcctctgcggaggcgccctgctttcaggccagtgggtcatcactgctgctcactgcggccgcccgatccttcaggttgccctgggcaagcacaacctgaggaggtgggaggccacccagcaggtgctgcgcgtggttcgtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcgccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacggtgggatggacctcgtcagctgcccaggccctcctctctctactcaggacccaggagtccaggccccagcccctcctccctcagacccaggagtccagg

SEQ ID NO: 144940 - DNA, 1389 bp, Homo sapiens
  Payload ID: 8645
  Gene Symbol: KLK15
  Gene Name: kallikrein-related peptidase 15
  Uniprot ID: Q9H2R5
  ENST ID: ENST00000326856
  CDS Start-End: 131-898
gttactcctcgaaaaactctacgaggggatcctctgattttaaggataagaaactgagacacagagaagaaaaaactcttaccagggtctcccaaaataactgcagccgaaccctggtccctcctccacaatgtggcttctcctcactctctccttcctgctggcatccacagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaa

SEQ ID NO: 144941 - DNA, 711 bp, Homo sapiens
  Payload ID: 8645
  Gene Symbol: KLK15
  Gene Name: kallikrein-related peptidase 15
  ENST ID: ENST00000602114
  CDS Start-End: 22-384
aaccctggtccctcctccacaatgtggcttctcctcactctctccttcctgctggcatccacagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaag

SEQ ID NO: 144942 - DNA, 855 bp, Homo sapiens
  Payload ID: 8645
  Gene Symbol: KLK15
  Gene Name: kallikrein-related peptidase 15
  Uniprot ID: Q9H2R5
  ENST ID: ENST00000598239
  CDS Start-End: 32-802
actgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctgg

SEQ ID NO: 144943 - DNA, 692 bp, Homo sapiens
  Payload ID: 8645
  Gene Symbol: KLK15
  Gene Name: kallikrein-related peptidase 15
  ENST ID: ENST00000596931
  CDS Start-End: 22-504
aaccctggtccctcctccacaatgtggcttctcctcactctctccttcctgctggcatccacagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaag

SEQ ID NO: 144944 - DNA, 374 bp, Homo sapiens
  Payload ID: 8645
  Gene Symbol: KLK15
  Gene Name: kallikrein-related peptidase 15
  ENST ID: ENST00000598673
  CDS Start-End: 245-374
gggcagtgctgaggtcacagaaagaacctgacctgagccccatcttcaagacccccagatggagaaaagaacaggccagacctcagcaacccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgc

SEQ ID NO: 144945 - DNA, 3019 bp, Homo sapiens
  Payload ID: 8646
  Gene Symbol: KLK2
  Gene Name: kallikrein-related peptidase 2
  Uniprot ID: P20151
  ENST ID: ENST00000325321
  CDS Start-End: 226-1011
gatctagtatgtgtggaacagcaagtgctggctctccctccccttccacagctctgggtgtgggagggggttgtccagcctccagcagcatggggagggccttggtcagcatctaggtgccaacagggcaagggcggggtcctggagaatgaaggctttatagggctcctcagggaggccccccagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgataggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagacctta

SEQ ID NO: 144946 - DNA, 2847 bp, Homo sapiens
  Payload ID: 8646
  Gene Symbol: KLK2
  Gene Name: kallikrein-related peptidase 2
  Uniprot ID: P20151
  ENST ID: ENST00000358049
  CDS Start-End: 17-688
ggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgataggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagacctta

SEQ ID NO: 144947 - DNA, 2674 bp, Homo sapiens
  Payload ID: 8646
  Gene Symbol: KLK2
  Gene Name: kallikrein-related peptidase 2
  Uniprot ID: P20151
  ENST ID: ENST00000391810
  CDS Start-End: 188-667
agccccaaactcaccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgataggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagacctt

SEQ ID NO: 144948 - DNA, 543 bp, Homo sapiens
  Payload ID: 8646
  Gene Symbol: KLK2
  Gene Name: kallikrein-related peptidase 2
  ENST ID: ENST00000600690
  CDS Start-End: 177-543
agctctgggtgtgggagggggttgtccagcctccagcagcatggggagggccttggtcagcatctaggtgccaacagggcaagggcggggtcctggagaatgaaggctttatagggctcctcagggaggccccccagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaaagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaat

SEQ ID NO: 144949 - DNA, 744 bp, Homo sapiens
  Payload ID: 8646
  Gene Symbol: KLK2
  Gene Name: kallikrein-related peptidase 2
  ENST ID: ENST00000595316
  CDS Start-End: 36-185
aaactcaccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagtgagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggtgagtgaagaccctaattctgggctgcaatctgaaagctaaccagacatctgcctcccctgctccccagctatagccacgccccctccccatgcctcatctgccgccctccttcccccttccctgactccctcaacacaagaggtgattctcacagcataattcacccattcctgtgttgagcacatgcttactgggcacctgctacgtgacca

SEQ ID NO: 144950 - DNA, 721 bp, Homo sapiens
  Payload ID: 8646
  Gene Symbol: KLK2
  Gene Name: kallikrein-related peptidase 2
  ENST ID: ENST00000597727
  CDS Start-End: 39-188
cccaaactcaccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggtgagtgaagaccctaattctgggctgcaatctgaaagctaaccagacatctgcctcccctgctccccagctatagccacgccccctccccatgcctcatctgccgccctccttcccccttccctgactccctcaacacaagaggtgattctcacagcataattcacccattcctg

SEQ ID NO: 144951 - DNA, 2834 bp, Homo sapiens
  Payload ID: 8646
  Gene Symbol: KLK2
  Gene Name: kallikrein-related peptidase 2
  Uniprot ID: P20151
  ENST ID: ENST00000597439
  CDS Start-End: 17-511
ggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagtgagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgataggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagacctta

SEQ ID NO: 144952 - DNA, 420 bp, Homo sapiens
  Payload ID: 8646
  Gene Symbol: KLK2
  Gene Name: kallikrein-related peptidase 2
  ENST ID: ENST00000597911
  CDS Start-End: 1-155
ctgagaaggtgacagagttcatgttgtgtgctgggctctggacaggtggtaaagacacttgtgggcataattcacccattcctgtgttgagcacatgcttactgggcacctgctacgtgaccagcattgccgtagaccctgggaagcagcagtgaacagtcaggagctgtggatggtgctggacagaagaaggacagggcctggctcagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggc

SEQ ID NO: 144953 - DNA, 528 bp, Homo sapiens
  Payload ID: 8646
  Gene Symbol: KLK2
  Gene Name: kallikrein-related peptidase 2
  ENST ID: ENST00000599568
  CDS Start-End: 398-528
acaaaaagtagccaggcgtggtgctgcgcgcctgtaatcccaattactagggaggctgaggcaggagaatcgcttgaacccgggagggagaggttgcagtgagccgagatcgtgccactgcactccagcctgggtgacagagcaagactccatctcagaaaaaacaaacaaacaaacaaacaacaaaaaaaatcgaaaggaggggaagggagctggagagagaaagggggacgtggccctgagctgtgggccgggccacccgccactacagagccctcactccagccccagctgcaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagcc

SEQ ID NO: 144954 - DNA, 550 bp, Homo sapiens
  Payload ID: 8646
  Gene Symbol: KLK2
  Gene Name: kallikrein-related peptidase 2
  ENST ID: ENST00000595050
  CDS Start-End: 1-550
accagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggagtcaggagctgtggatggtgctggacagaagaaggacagggcctggctcagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctca

SEQ ID NO: 144955 - DNA, 1002 bp, Homo sapiens
  Payload ID: 8646
  Gene Symbol: KLK2
  Gene Name: kallikrein-related peptidase 2
  ENST ID: ENST00000594174
  CDS Start-End: 42-251
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagtaagtaggaccctgggatctggggagggaatggctgtgtcccacaggaataacagcgggatgcttcccccagggtcacttctcaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaa

SEQ ID NO: 144956 - DNA, 892 bp, Homo sapiens
  Payload ID: 8646
  Gene Symbol: KLK2
  Gene Name: kallikrein-related peptidase 2
  ENST ID: ENST00000599121
  CDS Start-End: 36-185
aaactcaccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtc

SEQ ID NO: 144957 - DNA, 512 bp, Homo sapiens
  Payload ID: 8646
  Gene Symbol: KLK2
  Gene Name: kallikrein-related peptidase 2
  ENST ID: ENST00000593493
  CDS Start-End: 445-512
agtttctcagccacagagattcacagcctagggcaggaggacactgtacaccaggcagaatgacatgggaattgcgctcacgattggcttgaagaagcaaggactgtgggagatcacatctccatgatccataggccctgcccaatctgacctcacaccgtgggaatgcctccagactgatctagtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccg

SEQ ID NO: 144958 - DNA, 1463 bp, Homo sapiens
  Payload ID: 8647
  Gene Symbol: KLK3
  Gene Name: kallikrein-related peptidase 3
  Uniprot ID: P07288
  ENST ID: ENST00000326003
  CDS Start-End: 42-827
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgt

SEQ ID NO: 144959 - DNA, 1664 bp, Homo sapiens
  Payload ID: 8647
  Gene Symbol: KLK3
  Gene Name: kallikrein-related peptidase 3
  Uniprot ID: P07288
  ENST ID: ENST00000360617
  CDS Start-End: 1-717
atgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggagg

SEQ ID NO: 144960 - DNA, 1393 bp, Homo sapiens
  Payload ID: 8647
  Gene Symbol: KLK3
  Gene Name: kallikrein-related peptidase 3
  ENST ID: ENST00000422986
  CDS Start-End: 42-314
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 144961 - DNA, 834 bp, Homo sapiens
  Payload ID: 8647
  Gene Symbol: KLK3
  Gene Name: kallikrein-related peptidase 3
  ENST ID: ENST00000595392
  CDS Start-End: 22-396
cacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagacca

SEQ ID NO: 144962 - DNA, 552 bp, Homo sapiens
  Payload ID: 8647
  Gene Symbol: KLK3
  Gene Name: kallikrein-related peptidase 3
  ENST ID: ENST00000597286
  CDS Start-End: 36-552
aagcttaccacctgcacccggagagctgtgtcaccatgtgggtcccggttgtcttcctcaccctggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgct

SEQ ID NO: 144963 - DNA, 969 bp, Homo sapiens
  Payload ID: 8647
  Gene Symbol: KLK3
  Gene Name: kallikrein-related peptidase 3
  Uniprot ID: P07288
  ENST ID: ENST00000595952
  CDS Start-End: 8-664
tgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatcc

SEQ ID NO: 144964 - DNA, 1130 bp, Homo sapiens
  Payload ID: 8647
  Gene Symbol: KLK3
  Gene Name: kallikrein-related peptidase 3
  ENST ID: ENST00000596185
  CDS Start-End: 42-356
agccccaagcttaccacctgcacccggagagctgtgtcaccatgtgggtcccggttgtcttcctcaccctgtccgtgacgtggattggtgagaggggccatggttggggggatgcaggagagggagccagccctgactgtcaagctgaggctctttcccccccaacccagcaccccagcccagacagggagctgggctcttttctgtctctcccagccccactccaagcccatacccccagcccctccatattgcaacagtcctcactcccacaccaggtccccgctccctcccacttaccccagaactttctccccattgcccagccagctccctgctcccagctgctttactaaaggggaagttcctgggcatctccgtgtttctctttgtggggctcaaaacctccaaggacctctctcaatgccattggttccttggaccgtatcactggtccacctcctgagcccctcaatcctatcacagtctactgacttttcccattcagctgtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtg

SEQ ID NO: 144965 - DNA, 865 bp, Homo sapiens
  Payload ID: 8647
  Gene Symbol: KLK3
  Gene Name: kallikrein-related peptidase 3
  ENST ID: ENST00000598145
  CDS Start-End: 1-788
tcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagtt

SEQ ID NO: 144966 - DNA, 559 bp, Homo sapiens
  Payload ID: 8647
  Gene Symbol: KLK3
  Gene Name: kallikrein-related peptidase 3
  ENST ID: ENST00000601503
  CDS Start-End: 42-559
agccccaagcttaccacctgcacccggagagctgtgtcaccatgtgggtcccggttgtcttcctcaccctgtccgtgacgtggattgcaccccctctgcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggt

SEQ ID NO: 144967 - DNA, 810 bp, Homo sapiens
  Payload ID: 8647
  Gene Symbol: KLK3
  Gene Name: kallikrein-related peptidase 3
  ENST ID: ENST00000597483
  CDS Start-End: 27-614
acctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccct

SEQ ID NO: 144968 - DNA, 1035 bp, Homo sapiens
  Payload ID: 8647
  Gene Symbol: KLK3
  Gene Name: kallikrein-related peptidase 3
  Uniprot ID: P07288
  ENST ID: ENST00000593997
  CDS Start-End: 22-705
cacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaattctgggctggggtctagaagccaacaaggcgtctgcctcccctgctccccagctgtagccatgccacctccccgtgtctcatctcattccctccttccctcttctttgactccctcaaggcaataggttattcttacagcacaactcatctgttcctgcgttcagcacacggttactaggcacctgctatgcacccagcactgccctagagcctgggacatagcagtgaacagacagagagcagcccctcccttctgtagcccccaagccagtgaggggcacaggcaggaacagggaccacaacacagaaaagctggagggtgtcagga

SEQ ID NO: 144969 - DNA, 1341 bp, Homo sapiens
  Payload ID: 8647
  Gene Symbol: KLK3
  Gene Name: kallikrein-related peptidase 3
  ENST ID: ENST00000617027
  CDS Start-End: 42-704
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 144970 - DNA, 1347 bp, Homo sapiens
  Payload ID: 8648
  Gene Symbol: KLK4
  Gene Name: kallikrein-related peptidase 4
  ENST ID: ENST00000324041
  CDS Start-End: 1-765
atggccacagcaggaaatccctggggctggttcctggggtacctcatccttggtgtcgcaggatcgctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaggcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgc

SEQ ID NO: 144971 - DNA, 481 bp, Homo sapiens
  Payload ID: 8648
  Gene Symbol: KLK4
  Gene Name: kallikrein-related peptidase 4
  Uniprot ID: Q9Y5K2
  ENST ID: ENST00000431178
  CDS Start-End: 1-333
atggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacgggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaa

SEQ ID NO: 144972 - DNA, 691 bp, Homo sapiens
  Payload ID: 8648
  Gene Symbol: KLK4
  Gene Name: kallikrein-related peptidase 4
  ENST ID: ENST00000593885
  CDS Start-End: 186-401
ggaatgagcctggatccggggagccccagagggaagggctgggaggcgggaatcttgcttcggaaggactcagagagtcctgacttgaaatctcagcccagtgctgagtctctagtgaactaagctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacgaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgac

SEQ ID NO: 144973 - DNA, 813 bp, Homo sapiens
  Payload ID: 8648
  Gene Symbol: KLK4
  Gene Name: kallikrein-related peptidase 4
  ENST ID: ENST00000598305
  CDS Start-End: 279-494
atggccacagcaggaaatccctggggctggttcctggggtacctcatccttggtgtcgcagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaagtgagtgcagagctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacgaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattca

SEQ ID NO: 144974 - DNA, 777 bp, Homo sapiens
  Payload ID: 8648
  Gene Symbol: KLK4
  Gene Name: kallikrein-related peptidase 4
  ENST ID: ENST00000602148
  CDS Start-End: 1-228
atggccacagcaggaaatccctggggctggttcctggggtacctcatccttggtgtcgcaggatcgctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaagtgagtgcagagctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaa

SEQ ID NO: 144975 - DNA, 1563 bp, Homo sapiens
  Payload ID: 8649
  Gene Symbol: KLK5
  Gene Name: kallikrein-related peptidase 5
  Uniprot ID: Q9Y337
  ENST ID: ENST00000336334
  CDS Start-End: 354-1235
gccccagggagcagtgggtggttataactcaggcccggtgcccagagcccaggaggaggcagtggccaggaaggcacaggcctgagaagtctgcggctgagctgggagcaaatcccccaccccctacctgggggacagggcaagtgagacctggtgagggtggctcagcaggcagggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaa

SEQ ID NO: 144976 - DNA, 1405 bp, Homo sapiens
  Payload ID: 8649
  Gene Symbol: KLK5
  Gene Name: kallikrein-related peptidase 5
  Uniprot ID: Q9Y337
  ENST ID: ENST00000391809
  CDS Start-End: 196-1077
ataactcaggcccggtgcccagagcccaggaggaggcagtggccaggaaggcacaggcctgagaagtctgcggctgagctgggagcaaatcccccaccccctacctgggggacaggtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaa

SEQ ID NO: 144977 - DNA, 672 bp, Homo sapiens
  Payload ID: 8649
  Gene Symbol: KLK5
  Gene Name: kallikrein-related peptidase 5
  ENST ID: ENST00000594846
  CDS Start-End: 57-672
agacctggtgagggtggctcagcaggcagggaaggagaggtgtctgtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagt

SEQ ID NO: 144978 - DNA, 1365 bp, Homo sapiens
  Payload ID: 8649
  Gene Symbol: KLK5
  Gene Name: kallikrein-related peptidase 5
  Uniprot ID: Q9Y337
  ENST ID: ENST00000593428
  CDS Start-End: 156-1037
aatgtgccccagggagcagtgggtggttataactcaggcccggtgcccagagcccaggaggaggcagtggccaggaaggcacaggcctgagaagtctgcggctgagctgggagcaaatcccccaccccctacctgggggacagggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaa

SEQ ID NO: 144979 - DNA, 1511 bp, Homo sapiens
  Payload ID: 8650
  Gene Symbol: KLK6
  Gene Name: kallikrein-related peptidase 6
  Uniprot ID: Q92876
  ENST ID: ENST00000310157
  CDS Start-End: 244-978
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatga

SEQ ID NO: 144980 - DNA, 1708 bp, Homo sapiens
  Payload ID: 8650
  Gene Symbol: KLK6
  Gene Name: kallikrein-related peptidase 6
  Uniprot ID: Q92876
  ENST ID: ENST00000376851
  CDS Start-End: 441-1175
agacccaggagtccaggccctcactgcactcagggaccagtgctcccttccctggaggcctggtcaggggtcaccaagagcagagcgtgggggcgggaggaatgtgtgtgggaggcctgggtaaggaggaaaagggtgtagccagtctcctggctcagggacctgagagacaggggttaaaaggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatga

SEQ ID NO: 144981 - DNA, 1125 bp, Homo sapiens
  Payload ID: 8650
  Gene Symbol: KLK6
  Gene Name: kallikrein-related peptidase 6
  ENST ID: ENST00000376853
  CDS Start-End: 244-606
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 144982 - DNA, 1478 bp, Homo sapiens
  Payload ID: 8650
  Gene Symbol: KLK6
  Gene Name: kallikrein-related peptidase 6
  Uniprot ID: Q92876
  ENST ID: ENST00000391808
  CDS Start-End: 533-946
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 144983 - DNA, 1353 bp, Homo sapiens
  Payload ID: 8650
  Gene Symbol: KLK6
  Gene Name: kallikrein-related peptidase 6
  Uniprot ID: Q92876
  ENST ID: ENST00000597379
  CDS Start-End: 244-366
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggagcccggaggcctgcagcaggagcggccatgaagaagctgatggtggtgctgagtctgattgctgcaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 144984 - DNA, 928 bp, Homo sapiens
  Payload ID: 8650
  Gene Symbol: KLK6
  Gene Name: kallikrein-related peptidase 6
  ENST ID: ENST00000599690
  CDS Start-End: 258-467
acagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctga

SEQ ID NO: 144985 - DNA, 842 bp, Homo sapiens
  Payload ID: 8650
  Gene Symbol: KLK6
  Gene Name: kallikrein-related peptidase 6
  Uniprot ID: Q92876
  ENST ID: ENST00000594641
  CDS Start-End: 93-827
aggagaggatgcagagggagcagacagagggatggggggagggtcgaggcagtgactaatggaccatgtggcttcccctctcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgaca

SEQ ID NO: 144986 - DNA, 819 bp, Homo sapiens
  Payload ID: 8650
  Gene Symbol: KLK6
  Gene Name: kallikrein-related peptidase 6
  Uniprot ID: Q92876
  ENST ID: ENST00000599881
  CDS Start-End: 236-358
acagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcaggagcggccatgaagaagctgatggtggtgctgagtctgattgctgcaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctga

SEQ ID NO: 144987 - DNA, 1975 bp, Homo sapiens
  Payload ID: 8651
  Gene Symbol: KLK7
  Gene Name: kallikrein-related peptidase 7
  ENST ID: ENST00000304045
  CDS Start-End: 308-508
tcggagggagggtggagagagagtgcagtggtgccaattgctctcgctgcgtcagggttccagataaccagaaccgcaaatgcaggcgggggtgtcccagagtcggctccgcctgcaccccagggcgctggggccgggcatggggcggggggtgatataagaggacggcccagcagagggatgaagattttggagcccagctgtgtgccagcccaagtcggaacttggatcacatcagatcctctcgagctccagcaggagaggcccttcctcgcctggcagcccctgagcggctcagcagggcaccatggcaagatcccttctcctgcccctgcagatcttactgctatccttagccttggaaactgcaggagaagaagtgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcatggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaa

SEQ ID NO: 144988 - DNA, 1912 bp, Homo sapiens
  Payload ID: 8651
  Gene Symbol: KLK7
  Gene Name: kallikrein-related peptidase 7
  Uniprot ID: P49862
  ENST ID: ENST00000391807
  CDS Start-End: 103-864
ggagagggtgatgctggctccaagcctgactctgctctcgagagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcatggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtgggg

SEQ ID NO: 144989 - DNA, 1054 bp, Homo sapiens
  Payload ID: 8651
  Gene Symbol: KLK7
  Gene Name: kallikrein-related peptidase 7
  Uniprot ID: P49862
  ENST ID: ENST00000597707
  CDS Start-End: 332-877
agataaccagaaccgcaaatgcaggcgggggtgtcccagagtcggctccgcctgcaccccagggcgctggggccgggcatggggcggggggtgatataagaggacggcccagcagagggatgaagattttggagcccagctgtgtgccagcccaagtcggaacttggatcacatcagatcctctcgagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataa

SEQ ID NO: 144990 - DNA, 624 bp, Homo sapiens
  Payload ID: 8651
  Gene Symbol: KLK7
  Gene Name: kallikrein-related peptidase 7
  ENST ID: ENST00000593904
  CDS Start-End: 418-624
gattttggagcccagctgtgtgccagcccaagtcggaacttggatcacatcagatcctctcgaggtgagaagaggcttcatcaagggtgcacctgtaggggagagggtgatgctggctccaagcctgactctgctctcgagagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctgga

SEQ ID NO: 144991 - DNA, 1756 bp, Homo sapiens
  Payload ID: 8651
  Gene Symbol: KLK7
  Gene Name: kallikrein-related peptidase 7
  Uniprot ID: P49862
  ENST ID: ENST00000595820
  CDS Start-End: 247-1008
agataaccagaaccgcaaatgcaggcgggggtgtcccagagtcggctccgcctgcaccccagggcgctggggccgggcatggggcggggggtgatataagaggacggcccagcagagggatgaagattttggagcccagctgtgtgccagcccaagtcggaacttggatcacatcagatcctctcgagctccagcaggagaggcccttcctcgcctggcagcccctgagcggctcagcagggcaccatggcaagatcccttctcctgcccctgcagatcttactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcatggtcttgaacgcctgacctcagatgatccacccaccttggcctcccaaagtgctggga

SEQ ID NO: 144992 - DNA, 853 bp, Homo sapiens
  Payload ID: 8652
  Gene Symbol: KLK8
  Gene Name: kallikrein-related peptidase 8
  ENST ID: ENST00000291726
  CDS Start-End: 383-802
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 144993 - DNA, 456 bp, Homo sapiens
  Payload ID: 8652
  Gene Symbol: KLK8
  Gene Name: kallikrein-related peptidase 8
  Uniprot ID: O60259
  ENST ID: ENST00000320838
  CDS Start-End: 180-278
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 144994 - DNA, 555 bp, Homo sapiens
  Payload ID: 8652
  Gene Symbol: KLK8
  Gene Name: kallikrein-related peptidase 8
  Uniprot ID: O60259
  ENST ID: ENST00000347619
  CDS Start-End: 146-505
gagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggtt

SEQ ID NO: 144995 - DNA, 1051 bp, Homo sapiens
  Payload ID: 8652
  Gene Symbol: KLK8
  Gene Name: kallikrein-related peptidase 8
  Uniprot ID: O60259
  ENST ID: ENST00000391806
  CDS Start-End: 82-999
agagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttcc

SEQ ID NO: 144996 - DNA, 267 bp, Homo sapiens
  Payload ID: 8652
  Gene Symbol: KLK8
  Gene Name: kallikrein-related peptidase 8
  Uniprot ID: O60259
  ENST ID: ENST00000593490
  CDS Start-End: 1-99
atgggacgcccccgacctcgtgcggccaagacgtggatgttcctgctcttgctggggggagcctgggcagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaac

SEQ ID NO: 144997 - DNA, 1324 bp, Homo sapiens
  Payload ID: 8652
  Gene Symbol: KLK8
  Gene Name: kallikrein-related peptidase 8
  Uniprot ID: O60259
  ENST ID: ENST00000600767
  CDS Start-End: 491-1273
cgcccctcgtgatgtcaggggcgcagtagctccgcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctcaccttctttctgcctgagctgtgagatgagtggagagcaaacgggtgggcggtgaagggcagatgagggaaccggtaccgccttgcaactcccccttaaacccctatgttccagttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 144998 - DNA, 570 bp, Homo sapiens
  Payload ID: 8652
  Gene Symbol: KLK8
  Gene Name: kallikrein-related peptidase 8
  ENST ID: ENST00000595238
  CDS Start-End: 280-570
gcccacgtggagctcgggcggtgtagagctcagccccttgtggccccgtcctgggcgtgtgctgggtttgaatcctggcggagacctggggggaaattgagggagggtctggatacctttagagccaatgcaacggatgatttttcagtaaacgcgggaaacctcaccttctttctgcctgagctgtgagatgagtggagagcaaacgggtgggcggtgaagggcagatgagggaaccggtaccgccttgcaactcccccttaaacccctaacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaa

SEQ ID NO: 144999 - DNA, 481 bp, Homo sapiens
  Payload ID: 8652
  Gene Symbol: KLK8
  Gene Name: kallikrein-related peptidase 8
  ENST ID: ENST00000594669
  CDS Start-End: 1-163
cctgctcttgctggggggagcctgggcaggaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcct

SEQ ID NO: 145000 - DNA, 683 bp, Homo sapiens
  Payload ID: 8653
  Gene Symbol: KLK9
  Gene Name: kallikrein-related peptidase 9
  Uniprot ID: Q9UKQ9
  ENST ID: ENST00000544410
  CDS Start-End: 88-273
catggaggaggaaggagatggcatggcttaccataaagaagcactggacgccgggtgcacgttccaggatccaggtgcccaggggtcatgaagctgggactcctctgtgctctgctctctctgctggcaggtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactga

SEQ ID NO: 145001 - DNA, 754 bp, Homo sapiens
  Payload ID: 8653
  Gene Symbol: KLK9
  Gene Name: kallikrein-related peptidase 9
  Uniprot ID: Q9UKQ9
  ENST ID: ENST00000594211
  CDS Start-End: 2-754
catgaagctgggactcctctgtgctctgctctctctgctggcagggcatggctgggcagacacccgtgccatcggggccgaggaatgtcgccccaactcccagccttggcaggccggcctcttccaccttactcggctcttctgtggggcgaccctcatcagtgaccgctggctgctcacagctgcccactgccgcaagccgtatctgtgggtccgccttggagagcaccacctctggaaatgggagggtccggagcagctgttccgggttacggacttcttcccccaccctggcttcaacaaggacctcagcgccaatgaccacaatgatgacatcatgctgatccgcctgcccaggcaggcacgtctgagtcctgctgtgcagcccctcaacctcagccagacctgtgtctccccaggcatgcagtgtctcatctcaggctggggggccgtgtccagccccaaggcgctgtttccagtcacactgcagtgtgccaacatcagcatcctggagaacaaactctgtcactgggcataccctggacacatctcggacagcatgctctgtgcgggcctgtgggaggggggccgaggttcctgccagggtgactctgggggccccctggtttgcaatggaaccttggcaggcgtggtgtctgggggtgctgagccctgctccagaccccggcgccccgcagtctacaccagcgtatgccactaccttgactggatccaagaaatcatggagaactga

SEQ ID NO: 145002 - DNA, 1691 bp, Homo sapiens
  Payload ID: 8654
  Gene Symbol: KPTN
  Gene Name: kaptin (actin binding protein)
  Uniprot ID: Q9Y664
  ENST ID: ENST00000338134
  CDS Start-End: 109-1419
agcccgcgcaacggccgggcacccggcggttcaggtcgcttagagagtcgtaggttgggtagtgcgggttggggcgggggctgcggagagggtgcttaactgaggggcatgatgggggaggcggccgtggccgcggggccttgtccgttgcgcgaggacagcttcacgcgcttctcgtcgcagagcaatgtgtacgggctggcaggcggcgccggcgggcgcggggagctgctggccgccacccttaaaggcaaggtgctcggcttccgctaccaagacctccgacagaaaatccggccagtggccaaggagctgcagttcaactacattcccgtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtcccctgctggccatggctcacgtggacctgaccggggatgggctgcaggagcttgccgtggtctccctgaagggcgtgcacatcctgcagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgagaattggccacctgatggttatttatacgtccagaagaacatcatttccc

SEQ ID NO: 145003 - DNA, 806 bp, Homo sapiens
  Payload ID: 8654
  Gene Symbol: KPTN
  Gene Name: kaptin (actin binding protein)
  ENST ID: ENST00000595554
  CDS Start-End: 17-806
tgcttaactgaggggcatgatgggggaggcggccgtggccgcggggccttgtccgttgcgcgaggacagcttcacgcgcttctcgtcgcagagcaatgtgtacgggctggcaggcggcgccggcgggcgcggggagctgctggccgccacccttaaaggcaaggtgctcggcttccgctaccaagacctccgacagaaaatccggccagtggccaaggagctgcagttcaactacattcccgagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatt

SEQ ID NO: 145004 - DNA, 1623 bp, Homo sapiens
  Payload ID: 8654
  Gene Symbol: KPTN
  Gene Name: kaptin (actin binding protein)
  ENST ID: ENST00000594208
  CDS Start-End: 3-455
gcatgatgggggaggcggccgtggccgcggggccttgtccgttgcgcgaggacagcttcacgcgcttctcgtcgcagagcaatgtgtacgggctggcaggcggcgccggcgggcgcggggagctgctggccgccacccttaaaggcaaggtgctcggcttccgctaccaagacctccgacagaaaatccggccagtggccaaggagctgcagttcaactacattcccgtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggagtgagtgtcccctgcgcatcgacgcccactccactatggtgggttggatttggtctgcaggtcataacttggccaacctctggtctaacagggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccacgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtcccctgctggccatggctcacgtggacctgaccggggatgggctgcaggagcttgccgtggtctccctgaagggcgtgcacatcctgcagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgag

SEQ ID NO: 145005 - DNA, 743 bp, Homo sapiens
  Payload ID: 8654
  Gene Symbol: KPTN
  Gene Name: kaptin (actin binding protein)
  ENST ID: ENST00000600271
  CDS Start-End: 616-743
gtaggttgggtagtgcgggttggggcgggggctgcggagagggtgctcggcttccgctaccaagacctccgacagaaaatccggccagtggccaaggagctgcagttcaactacattcccgtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagcc

SEQ ID NO: 145006 - DNA, 6139 bp, Homo sapiens
  Payload ID: 8655
  Gene Symbol: KPNB1
  Gene Name: karyopherin (importin) beta 1
  Uniprot ID: Q14974
  ENST ID: ENST00000290158
  CDS Start-End: 408-3038
aacggccaatcgtcgtggagcgcggcgcctccgcggagaggtccggtccgaatatccctccgccttcctccctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttttgtttactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgttgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttatttttattttcaa

SEQ ID NO: 145007 - DNA, 3163 bp, Homo sapiens
  Payload ID: 8655
  Gene Symbol: KPNB1
  Gene Name: karyopherin (importin) beta 1
  Uniprot ID: Q14974
  ENST ID: ENST00000535458
  CDS Start-End: 739-2934
gttgccgggcacctcccgccttcccgcgccccgaccccgaactcctctccttagttctcccgggcaccctatcctatcaacgcctactatcccagccaatcgcgcaggatccgagtcgtgcctccggtccaccctcctcccagcgctcagccggtctgagctcaaggcctttaccaagcccacccaatcaacggcgggctctctcctaccccatcccaatctccctcccctcggccaatccgcgcgctccattccgctgcccgcccagccaacccgggccttgaaaccagcaggcgaatgggcgcgagacggcccttcgacgctgagcgcctggccagttagggattccgcgtggccaggacaacggccaatcgtcgtggagcgcggcgcctccgcggagagcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccat

SEQ ID NO: 145008 - DNA, 2989 bp, Homo sapiens
  Payload ID: 8655
  Gene Symbol: KPNB1
  Gene Name: karyopherin (importin) beta 1
  Uniprot ID: Q14974
  ENST ID: ENST00000540627
  CDS Start-End: 518-2713
atttaaggggtccggagaaaatgaagctaagtccgctagagactggtcctttgtataaaaatgtgggatggattggttgaaacagcctagatgccagttaagtttctctttggtgtccatctcctgttgggggatggggtcagagggaaggattggatgatgcttgacatctttgagaaagcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttattt

SEQ ID NO: 145009 - DNA, 653 bp, Homo sapiens
  Payload ID: 8655
  Gene Symbol: KPNB1
  Gene Name: karyopherin (importin) beta 1
  ENST ID: ENST00000582126
  CDS Start-End: 1-68
ctaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgat

SEQ ID NO: 145010 - DNA, 2347 bp, Homo sapiens
  Payload ID: 8655
  Gene Symbol: KPNB1
  Gene Name: karyopherin (importin) beta 1
  ENST ID: ENST00000582097
  CDS Start-End: 1-2071
tgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcagacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttattt

SEQ ID NO: 145011 - DNA, 742 bp, Homo sapiens
  Payload ID: 8655
  Gene Symbol: KPNB1
  Gene Name: karyopherin (importin) beta 1
  ENST ID: ENST00000583013
  CDS Start-End: 1-742
cttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagtagagacagggtttcaccatgttggacaggatggtctcgatctcctgaccctcgtgatccacctgccttcgccccccaaagtgccaggattacaggcatgagccaccatgcccggccaactaccatatttttatataggatgaagaacttgggacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcag

SEQ ID NO: 145012 - DNA, 896 bp, Homo sapiens
  Payload ID: 8655
  Gene Symbol: KPNB1
  Gene Name: karyopherin (importin) beta 1
  ENST ID: ENST00000583648
  CDS Start-End: 451-896
cttcccgcgccccgaccccgaactcctctccttagttctcccgggcaccctatcctatcaacgcctactatcccagccaatcgcgcaggatccgagtcgtgcctccggtccaccctcctcccagcgctcagccggtctgagctcaaggcctttaccaagcccacccaatcaacggcgggctctctcctaccccatcccaatctccctcccctcggccaatccgcgcgctccattccgctgcccgcccagccaacccgggccttgaaaccagcaggcgaatgggcgcgagacggcccttcgacgctgagcgcctggccagttagggattccgcgtggccaggacaacggccaatcgtcgtggagcgcggcgcctccgcggagagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtc

SEQ ID NO: 145013 - DNA, 605 bp, Homo sapiens
  Payload ID: 8655
  Gene Symbol: KPNB1
  Gene Name: karyopherin (importin) beta 1
  ENST ID: ENST00000577875
  CDS Start-End: 424-605
gctccgtctcccactttcctccccctagatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaa

SEQ ID NO: 145014 - DNA, 6830 bp, Homo sapiens
  Payload ID: 8656
  Gene Symbol: KPNA1
  Gene Name: karyopherin alpha 1 (importin alpha 5)
  Uniprot ID: P52294
  ENST ID: ENST00000344337
  CDS Start-End: 178-1794
gccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgtacctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctggagtcaaggggtttttctttctcgctagttttgtgaaaatttttatatcaataggcaaatcattataactttttaggggttgatggtttttaagtatattggaaattgtggtgtctaaggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggttttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaata

SEQ ID NO: 145015 - DNA, 727 bp, Homo sapiens
  Payload ID: 8656
  Gene Symbol: KPNA1
  Gene Name: karyopherin alpha 1 (importin alpha 5)
  ENST ID: ENST00000482287
  CDS Start-End: 84-727
ggagccctggtgtgatcgccatcgggaacgccggtcgaggctaggcggggcggggcggcgtggcgcggcggcggggctaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccc

SEQ ID NO: 145016 - DNA, 575 bp, Homo sapiens
  Payload ID: 8656
  Gene Symbol: KPNA1
  Gene Name: karyopherin alpha 1 (importin alpha 5)
  ENST ID: ENST00000476916
  CDS Start-End: 69-575
actgcgaacgccggctgagctgagtctcgctgctcggtgcgaggcggcggagagcgaggcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcaggcagtctgggctcttggcaacattgctggagatagtaccatgtgcagggactatgtcttagactgcaatatcctt

SEQ ID NO: 145017 - DNA, 1923 bp, Homo sapiens
  Payload ID: 8656
  Gene Symbol: KPNA1
  Gene Name: karyopherin alpha 1 (importin alpha 5)
  ENST ID: ENST00000494339
  CDS Start-End: 184-732
gcgaacgccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcaggtgagcctggcatttgctaggaaccagagtggaaccggcaaagtggccagcaacagagtcctgatccaaatggagaaagggaaccaggcgtacctcaacctggagtgggaaacttgataggagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttga

SEQ ID NO: 145018 - DNA, 596 bp, Homo sapiens
  Payload ID: 8656
  Gene Symbol: KPNA1
  Gene Name: karyopherin alpha 1 (importin alpha 5)
  ENST ID: ENST00000493510
  CDS Start-End: 73-596
gctcggtgcgaggcggcggagagcgaggcctggtgagcaccgccgaggcgcgggccagctcttcgagaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcat

SEQ ID NO: 145019 - DNA, 1062 bp, Homo sapiens
  Payload ID: 8656
  Gene Symbol: KPNA1
  Gene Name: karyopherin alpha 1 (importin alpha 5)
  ENST ID: ENST00000465882
  CDS Start-End: 77-1062
gcaggcgcactgcgaacgccggctgagctgagtctcgctgctcggtgcgaggcggcggagagcgaggcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatat

SEQ ID NO: 145020 - DNA, 1843 bp, Homo sapiens
  Payload ID: 8656
  Gene Symbol: KPNA1
  Gene Name: karyopherin alpha 1 (importin alpha 5)
  ENST ID: ENST00000485027
  CDS Start-End: 73-621
ctgagctcttagaataacagagctcttcacagtaaactcatttgttctctccccacttgtattgtagaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattagtaacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcaggtgagcctggcatttgctaggaaccagagtggaaccggcaaagtggccagcaacagagtcctgatccaaatggagaaagggaaccaggcgtacctcaacctggagtgggaaacttgataggagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgtacctgtgtca

SEQ ID NO: 145021 - DNA, 2181 bp, Homo sapiens
  Payload ID: 8657
  Gene Symbol: KPNA2
  Gene Name: karyopherin alpha 2 (RAG cohort 1, importin alpha 1)
  Uniprot ID: P52292
  ENST ID: ENST00000330459
  CDS Start-End: 346-1935
gctccctcaccgcccggccgctccctcatctcgcgatgccatcctctttttttttttttctttcccccctcccactcgcccccaagccctatgactccctcccctcccaacgtgtttttcaaatccaccaatgggcacacagcttaggctcgaaccagccaatcggaatgcggagtcaccgggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccaccctt

SEQ ID NO: 145022 - DNA, 2456 bp, Homo sapiens
  Payload ID: 8657
  Gene Symbol: KPNA2
  Gene Name: karyopherin alpha 2 (RAG cohort 1, importin alpha 1)
  Uniprot ID: P52292
  ENST ID: ENST00000537025
  CDS Start-End: 621-2210
gttgactaggcctcgggggcgacgttcattgaccaggcggctgagtttcgcggggtctgcgggtttagggcgccgacgctctgcaaacggcagcggaggccttaacgcgtcgcggccgggagaatcggagcgagccaggcttgagggcgaatgtcccgggaggacttgtggcggccctggtttcgcctcctcctttctcgttgcatcttccccggcgtgggggcaggggctgggggtggcagttgggagcaccgtctctgacacctaggccccgggggtggctctgccaccaagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgatgaagcaaatttttatttaattttcgagtctgcacctattttggccaagtaaagacagtaaaatagggagagcctcctgaggatctgaatttattgccctggcacataatttttagctctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccaccctt

SEQ ID NO: 145023 - DNA, 569 bp, Homo sapiens
  Payload ID: 8657
  Gene Symbol: KPNA2
  Gene Name: karyopherin alpha 2 (RAG cohort 1, importin alpha 1)
  ENST ID: ENST00000579754
  CDS Start-End: 140-569
cctctagtatacaggtgtggattcagtagatgcttgataattcagttcttatttggtactattattgacaaaggaaaatgataaaggaaatatttttctcttcccccatcttttagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcac

SEQ ID NO: 145024 - DNA, 611 bp, Homo sapiens
  Payload ID: 8657
  Gene Symbol: KPNA2
  Gene Name: karyopherin alpha 2 (RAG cohort 1, importin alpha 1)
  ENST ID: ENST00000583269
  CDS Start-End: 157-309
aaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagtgaaacggcatgttatcttttctcaaggaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttggg

SEQ ID NO: 145025 - DNA, 561 bp, Homo sapiens
  Payload ID: 8657
  Gene Symbol: KPNA2
  Gene Name: karyopherin alpha 2 (RAG cohort 1, importin alpha 1)
  ENST ID: ENST00000584026
  CDS Start-End: 160-561
acacggtctttgagctgagtcgaggtggaccctttgaacgcagtcgccctacagccgctgattccccccgcatcgcctcccgtggaagcccaggcccgcttcgcaggaaatatttttctcttcccccatcttttagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagt

SEQ ID NO: 145026 - DNA, 4474 bp, Homo sapiens
  Payload ID: 8658
  Gene Symbol: KPNA3
  Gene Name: karyopherin alpha 3 (importin alpha 4)
  Uniprot ID: O00505
  ENST ID: ENST00000261667
  CDS Start-End: 416-1981
gccccgcgcctgaggggcagtaaaagtcgccaggtccggctccatttctggcacaaaacttgcagcaccgaggggttgtggagagcccttgcaggggaagagggcagggtcatcccgagaaccaacgggcacgtatagcccggcgaacgcccaagccggtcaccgcccccggtcacgtgtcgccagcctccgcggccgcgcgccgctctcagcaccgttcccgccccacccggcccggcagtcggcccgcgcctcccccggcgctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccgccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttaaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaactta

SEQ ID NO: 145027 - DNA, 588 bp, Homo sapiens
  Payload ID: 8658
  Gene Symbol: KPNA3
  Gene Name: karyopherin alpha 3 (importin alpha 4)
  ENST ID: ENST00000436760
  CDS Start-End: 1-275
caccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttaaaa

SEQ ID NO: 145028 - DNA, 8981 bp, Homo sapiens
  Payload ID: 8659
  Gene Symbol: KPNA4
  Gene Name: karyopherin alpha 4 (importin alpha 3)
  Uniprot ID: O00629
  ENST ID: ENST00000334256
  CDS Start-End: 307-1872
gcagcgccggggccctcagatcgaggctgcctccccctctcagccggcagcacattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggagactatgagaagacaacgaaatgaagttgtagttgaattaaggaagaataaaagagatgaacatctcttaaagagaaggaatgtaccacatgaagatatctgtgaagactctgatatagatggtgattatagagtgcaaaatacctctctagaagctattgttcaaaatgcttcaagtgataaccaaggaattcaattaagtgcagttcaagctgctaggaagcttttgtccagtgatcgaaatccaccaattgatgacttaataaaatctggaatattgcccattttagtccattgtcttgaaagagatgacaatccttctttacagtttgaagctgcatgggctttgacaaacattgcatctggaacttctgaacaaactcaagcagtagttcagtccaatgctgtgccacttttcctgaggcttctccattcaccccatcagaatgtctgtgagcaagcagtgtgggcattgggaaatatcataggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggagattcttccagccctttgtgttttaattcatcacacagatgtaaatatactggtagacacagtctgggccctctcttaccttactgatgctggcaatgaacaaatacagatggtaatagactctggaatagttcctcatttggttcctctgctcagccaccaggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataagggggattttggcactcaaaaagaagctgcttgggccataagtaacttaacaattagtggaaggaaagatcaagtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgatattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgttttacatggggtgtgtgtgtgtggtgtgtggatttttttttttttataaagttagagtataattcaatggcttacattagcttcctgtctttttacctagaaccagcataataagaaatttctttggttctgtcatttcagtatggacatattaatattttagcccactgagtttgtccagttgacaccatcagtgcttcagttttctctctatccaaagcaaggttttaactttccttcattctccagtaaaacagaccgagacaacttgaactatattttgagtattgctatatcttcaacatatagctccaaatgatggattgtatacaaagcatagtacagaaggtttcagtaattggaaggtgaacacagcaatgctttacataatttgtgttttttagtaaaaaatattggattcaaagtaagccaatgagcttgtatacaaattttatatacaaattattgtatagaacagtgatatggaaaataggtaagggtgatattaatatctctgggtataaggactaccttatcgtttaaatattttatttccatctatagcctaatatagaacattgattttctagtagaaattctgggaagggcttttctgtctctgaaattgattcagtacagttgacagttcatcacggttacctggttaaacactttttttttttttttaattctccagtgatctaggaaattgtttcatttttaacacaggcttatttctgatggggatgggggcatagaataatatgcctaataagctaaacgttcttaacgtttcatgtcttaaactgtctttttgaacattgagaccacctcaagtgctgtaaaaataagaatgttatattaggggtgtgtgagacgccctagtctaaaatctatctttaaatatatttcctttgtaattttcaaagacttcagtaattgtgtgttatggtggaaataatactttccattggtccacattgctctggaccaaacctggagcatttctataattagagctatctatgaatcattaaaaatggatctagaataattttggggagagggagtgtatcatttagtttaggcttacctcagcagcacttcatagggtgaggagttgtttgtttctttaaaggtataactgcattgtaaaatgactgggtttattgtaacagtaatttatgggggcaccctttttggattctccattgcctcagtttcctcaaggaaaaagttacagagattaagctaaattttgaatttagagaataactgctgtgtaattttggtataattaccataaatttagtgtcttaaaacacaacatacattatttcacaatttctgtaggtcaagagtgtagttaggttttctgctcagggtctcacaaggctgcaataaaggtgtcagccagagctgcagtcttatctgaagctagggggtcctcttttatgcacatatggcaaaatccattgcctagcaactgaagaaatcatgggaacttcttcaaggccagcaagagaatctctgatctcagggaaggccttaagcgcttttttaaaggtctcacctgattagatcaggccacctacccaccagggtgatctcccttttgattaacccaaagccaaactgatgaggtaccttcattacccctgcaaaatcccttcacctttgccctgcattgtagtccaatcacaggggtgatacgcatcatattcaaagatcctgttcacagtcaagggagggggttatatggagtatgtataccagggaatcttgggagccatcttaagagttcttcctatgacaaggactcaactatttagaactggaacaatttacaagtgatagccttatatagttatcatagcaagcttatttggggatcaaggttgcctctgagaacctaatgaaaactggaccagcttccccaaaaagtgtatatacatggtagtttttcatacagttttaggggattcataagagtccatgaattacagtctgtcccaacccttccctttagatgatgagttgttgaggtgacttgcccaaggtcacacagctactaagggccaaataaagcccacatctcaactcccatactgcccagggcttctaattactattctaaaggtaatctaaattcatttaaatttgtgaaccaatgcaaaaaaatgtgaatgtagctttttggatattttttttgtttactaaggaatgggtaacattgttatagaagcttgcctaagagttttgaaattagttgacctttttgagtttccaaaattgaatcttccattgtagctattaaagtgaactataaataggccaactttaattgttaactcctcgggtttggtggattatctaccatttatatataaaatttcagttagaatccaccattggcgttttgaaggccaagatagctgagtatcttatcctttttgtaacttcttgattattttacttattggcaaaattcattaactgtcagccaataatttaatattatgggaggaaaaaattttgcccagatatctgaggcaatactcccaaacactaacaaactgatgcctaacaaacttgacattttgaacacttaaagttttccctaaactttttaataagcacattaataaagtatgcttttaaatatatatgtacaataatttttaaaagttgctgcaagatgccttcaaatcaatatgcacgttggtggcattagtgcagtcttctatttttatttttttgagacacagtctcgctctgtggcccaggctggagtgtagtggcgcaatctcggctcactgcaacctctgcctcaagggttcaagcaattctgcctcagcctcctgagtagctgggattacaggagtacgctaccacgcctggctaatttttgtatttttagtagaaatggggtttcaccgtattggccaggctggtattggaatcctgaccgcaaatgatctgcccacctcggcttcccaaagtgctgggattacaggcgtgagccactgcgcccaaccagccttaattcttaataaaggaagttgaaaaataatgaacattggtaaaactattctagtgtgatcagaagcaaatttggactgtagtgtcaaattgataaaaaactaagcacaccaatcatgtataagaaaagtagatttaacatttttttccctaaacacttaacccagaagttaacaataatcttgaaaattccttttaaatccaggccctttaggtgatggcagtttgactcaggatgtccaagtccagtgtattttcaataaaattgacttgacagctactgctctgggtgtaagagcagttgactgtgaggaaaagtaaatggttctacagattctttatgatctacctcccaccagaggactgcagtactcccttgttatttatattttctgccccaatttttgccttctccacaaattttataccttttgtagctgcctactccagattacttcacctttccagactatcagttcttccacttttattcttcataaagaaaattccaataacctgtttcacttaggtttttctattactcttcaagcatgaatcctaatttccctgactatatcttacctctgatctccataactgatggattcctatcctagactatgttactctaatattacccaagattttctccagcctgtttttactcttactttgaaacagctgtttaaaatgactcgtaatctgcttaaatctacatgctttttgtggttctcaatccagttacctaccttccagataattccctcactgtcctgtcctctccattcctctgatgtttaagccctgtgagccacctttcccccatcctttgtgcatagttaccattttactctttcttgttgcccaggcaggaatgcagtggtgccatcttggctcactgcaacctccacctcctaggttcaagcgattctcctgcctcagcctcctgagtagctgggaccacaagcgtgcaccaccacgcccggctaatttttgtatttttagtagagatggggtttcaccacgttggccaggctggtctcgaactcctgacctcagatgatccaccctccttggcctcccaaagtgctgggattgcaggcgtgagccaccgcctggccaccattttactctttttaggtacagtaatctaatatccaaagtcttggactcagctaaagagggtatttaccttaaaaaaaaaaaaaaaaagactccatcttttgattcataattgtggtgggggcggggaatcaagacaaccttagtcactttggtattaccataattcttgtcttttcagggttgtcctgttcagctgcataaaacatcatgtattctaggtatttcctaccttcacttacatttttacttgccgatgtgctgccttcataaatgggtatattccgccacacatctagtaagcccccaatgcagtacacaatgtgtatcactgataaaactcgcacttctgccatgtcagtattatattcagttgagtggtctttagcatagtggcagtcctagtcatcctaaccttttagttaaggtaaaattacatatgtttatagaactcatatagacaagctagtttttaaaatcttccttttaaccagtttaggatgatctaggatagctaagttacctacatggtgactgttcggtctaattcagaaacagaagtactaaaagaatactaaaaagtttttacccattatctctatccctgttttctttttgcaattctcagctgcagggagcaagaaaatacacagcagataggaaatgtttgtttgcatcctggctttctcaaccgcactttacgtccttgaatattctagatatttactccttcaagaagtcaggagtatatccaggcctacctatcatccttgccatccccattaaccctcatttttcagtatgtgttttacatttatggttatttttcagtctatagtatctgttcactcattgctctatcacatctgagtttctccgtctttctttccactagattgtaagctccttaagggcaaggtcggcatataagcaaagttctgtaaacaccgtgaaggtaccatgagttctatgggtactcaataaatgcttgtgataatgatgcaatttctca

SEQ ID NO: 145029 - DNA, 510 bp, Homo sapiens
  Payload ID: 8659
  Gene Symbol: KPNA4
  Gene Name: karyopherin alpha 4 (importin alpha 3)
  ENST ID: ENST00000483437
  CDS Start-End: 1-510
caggaagttaaagttcagactgctgcacttagagctgtgggcaacattgttactggaactgatgagcaaacacaagtagttttgaactgtgatgctctttcacacttcccagcactcctgacacatcccaaagagaaaattaataaagaagcagtgtggttcctctccaacatcactgcaggaaatcagcagcaggtacaggcagtaattgatgccaatcttgtaccaatgataatacaccttttggataaggtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggagggctggagaaaattgaacaacttcaaaatcatgaaaatgaagacatctacaaattggcctatgagatcattgatcagttcttctcttcagatgat

SEQ ID NO: 145030 - DNA, 2157 bp, Homo sapiens
  Payload ID: 8660
  Gene Symbol: KPNA5
  Gene Name: karyopherin alpha 5 (importin alpha 6)
  Uniprot ID: O15131
  ENST ID: ENST00000356348
  CDS Start-End: 132-1751
ggccgccatcttggattgcgaactgggtcgctacgcttcacgccaggggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcagaaatgacagactttttcattgaatgatgaggacacagcagccatattatgccaagaggaaaaatatcatgatcatattgaaagatcaagcatgagcttccatggtgaagtcttctgtaccaatgcaccagagaatgcctaccatccaaaaaagcagtcagctgatggaaaagaagattattaaacctttgttctgggatttactgttaaaaaacaaacaaaaaacaacaaaaaagcggtgacaggaaacagttaaggaaatgatttaactgaagggaagcaagatttttttaaagcattgttcttaatccccatgactgtccttcagtcacaattccagaataaaagaatctactttgtgt

SEQ ID NO: 145031 - DNA, 5089 bp, Homo sapiens
  Payload ID: 8660
  Gene Symbol: KPNA5
  Gene Name: karyopherin alpha 5 (importin alpha 6)
  Uniprot ID: O15131
  ENST ID: ENST00000368564
  CDS Start-End: 149-1768
ggagaaggggcgcaggtggccgccatcttggattgcgaactgggtcgctacgcttcacgccaggggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcaggtaactcctctttgttgccaatgtaagaatgtttgtttttttacatagaacagtaaagagaatttgatgcacttttagaaagcaaaatgaaacaaaaatttccattcagatgcaacctttcattgtagtttgttgttgttttagttttgttgttgtgcctgtatttatatcttctattgtttggatttttgtatctatttgtgaataattgaatatgcaattatttagtaatttaagcttgaaaaggagaattttggtgaagcattacttagtaattctgaattttttcaagcattcttggaaactgcacattagcagtaaacctattgataattgcattttggcagtaagtcttacacatctaatctctactaaatctacctctatcttgaagcagaaataaaaacaaaaaagcttcagaagcatgaaataatgcaaatgctaaattagaatgtgaaaatatttattaccttaaattatacatatcactgtgctgtaggttatactttgcaaaaaattgcaacagaaaacctataaaatttatttataaaacagaagaaatattatactgataatccattaaaatgtggcaattgtgaagggagaagctgtttttcatgttgaacacattaaaaagattactttataaaatgtttaaatatttctgtttttaacatataagtgctatgtatattagtatattttgtatttcaaccaaatatgctaccatttttgaaatagtgttttattgtttttcactcattgttttaaagagcatcatgacagagatgtcatcatgaatctaaagtagtgctgcatatctaaaataataactaattatttctctgatttttcagagcagtaattgaaaagtttcattttctgtataatagtactagtttaagtttaagtacaagtacaagtttaggtactcgaatgacaaaattaccctgaagaaataaccttattatgtgttaaattgtattaaatgcatttaacatttggatgctaaatgataatgaaaattgctaaaggttctttaatatggttcaaatctataagacttttttcttttagtaatactcagagggtcattctgctgcttgttatgaatcatagattacattcatgtcagattgatcaatatgtatgttttatgatttaacagcaaaaacctcttcaaacggaaaatttgaaagaaaggtttcaatagaaaaattatatatatatttatacatatatatgtgtgtgtgttactctcacagttcaactactgttgaactcaatcttttaatttatagttatacgtaggctatttatgtgtccaattgtatacctagaatacttacttaaaacttagtttacaactctttttaagatgagaactaaggcaattttgatatgattcatggtctattctttaaaaaaagatttcatttatgatagtatttgtaatgtttctgctggaaatcagaggcacgttccaagaggaaaatgtatataggagtacttttaaagaatatgtcactttgtaaattacatatcatgaaactaagcttttgacaagatacttaaaacctacagctgtaaaatacaggtttaaatggtgttcgtaatgctgagtgcatctgccagcccttttttattattaagtagaagattgtatctgtgccccttttttcgtagtggaaggtatatagccgagtataaaatggttttcttttgcattatctgtattcaaaaaacagggtagttatattaaagcttaccaaattgatggtgaatttatcagattaacctttttgtggtgcagatggttctaagtatcaggtgacagggtattctactctttctagtcaattaaaattgataatgcagcatgattcataaactaaccagctgtgcctccttttattttgaggaccctgtagtcactataataaatttctaagccaaatttttcaaacaagatagttcttatagaaggagaaataataaatatgtgtgtgttgatgcatgcacacagaatgacctgtgaaaggaaacttaaattttgccggtaaaacaaacatatctctacagactgtgattatacttcataagcatttaaatacagttttatttatttccttaaatatattacttgggtaattaattttagatttgattgcaaagagcactgtatagcagttgggaccagctcttggcttggcttggcttggcttattgttaagagtttattggatcaagactaacaaataactttgtgatgaaaattcttcaaaaatatagctactcttttcaagtataccatttaaaatatttcatcaggcagagccctgaccaggaaaaaaaaaaaaaaagaaagaaagaaaagaaaaaaataaataaaatgctccaaaaagtgttttcagtagtcttcactggcccttgtgggaggaaaaatacttttttaacttgcttttctaagatttgttatatttaaatccaagagaaactatgccgaaaaaaagtgttataaagaggaatgcatgtagcattaatgcaaatatcaagaaaatacttgaaagagtccttttcatttatttaattaaatttggtgttttattttgtctgaatctgaatttctcctatttaatctatgcaattatgcttgttttatatttataagcacttgactcactgggtgtggtctttttactgtgttttatttcaaaacgttgttttaagtgatagtgtccttaaattttagtgtcatttggtcaacttactggtaacaccagaacaagaaagcaaaaaagtaataaattctgctggcacagaactaacatatcatttggtaactgtaaaacctatttgcagttaaaggttgatttattggataagggactaaaagaagcatatattacctttgcctttatattttttcttcttttaagaaggagcattatggaaaaataaatataaagtcttagtgaatttttgttatggttctcaattcagcaatctactggctgcttgcgaaactgtgaaatcaaattgttcttaacctttattcagtttagtttatagcattactgttttatgaaatgtgacattttaggagccaatataatagagctctaaaaggatagtatatctttaaattctgactggggagtaagaagagaagatattcttaccctactaaataaaccaacttttgagtagtatgcaatattatgaaatgttacaacactatattaaaaataataaaatattttaaaattgcattta

SEQ ID NO: 145032 - DNA, 773 bp, Homo sapiens
  Payload ID: 8660
  Gene Symbol: KPNA5
  Gene Name: karyopherin alpha 5 (importin alpha 6)
  ENST ID: ENST00000392517
  CDS Start-End: 1-367
gtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcagaaatgacagactttttcattgaatgatgaggacacagcagccatattatgccaagaggaaaaatatcatgatcatattgaaagatcaagcatgagcttccatggtgaagtcttctgtaccaatgcaccagagaatgcctaccatccaaaaaagcagtcagctgatggaaaagaagattattaaacctttgttctgggatttactgttaaaaaacaaacaaaaaacaacaaaaaagcggtgacaggaaacagttaaggaaatgatttaactgaagggaagcaagatttttttaaagcattgttcttaatccccatgactgtccttcagtcacaattccagaataaaagaatctactttgtgt

SEQ ID NO: 145033 - DNA, 689 bp, Homo sapiens
  Payload ID: 8660
  Gene Symbol: KPNA5
  Gene Name: karyopherin alpha 5 (importin alpha 6)
  ENST ID: ENST00000413340
  CDS Start-End: 264-689
ggagaaggggcgcaggtggccgccatcttggattgcgaactgggtcgctacgcttcacgccaggggcggagtggcggcccttctgttacccgccacacacgtcgccgctggggactgggaaatcagggcatcggagagtgccacattaatgggtctctggaacctggcggtgccgggtgtttctcgtgttttccccagggcgacagcggtcgcgggggcgtggcagccggacctttcccttgcggacgcgaaggcgtgatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaa

SEQ ID NO: 145034 - DNA, 7378 bp, Homo sapiens
  Payload ID: 8661
  Gene Symbol: KPNA6
  Gene Name: karyopherin alpha 6 (importin alpha 7)
  Uniprot ID: O60684
  ENST ID: ENST00000373625
  CDS Start-End: 94-1704
ccgtcctacagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaatccacatcttcagctgggcgcggtggctcatgcctgtaatcctagcactttgggaggctgaggcgggcagatcacttgaggttaggggttcaaaaccagcctgaccaacatagtaaaaccccgtccctacaaaaataaaaaaataaaaaaaataagccaggtgtggtggtgggcacctgtgatctcagctacgtgggaggctgaggcaggagaatctcttgaacctaggaggcagaggttgcagtgagccaagattgtgccagcctgggcgacagggtgaggctcttgtctcaaaaaaaaaagtccacatcttcatgaaccctcagactctggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagttctaaa

SEQ ID NO: 145035 - DNA, 965 bp, Homo sapiens
  Payload ID: 8661
  Gene Symbol: KPNA6
  Gene Name: karyopherin alpha 6 (importin alpha 7)
  ENST ID: ENST00000446515
  CDS Start-End: 1-965
cggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcag

SEQ ID NO: 145036 - DNA, 3941 bp, Homo sapiens
  Payload ID: 8661
  Gene Symbol: KPNA6
  Gene Name: karyopherin alpha 6 (importin alpha 7)
  ENST ID: ENST00000471599
  CDS Start-End: 74-634
attgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagttt

SEQ ID NO: 145037 - DNA, 1725 bp, Homo sapiens
  Payload ID: 8662
  Gene Symbol: KPNA7
  Gene Name: karyopherin alpha 7 (importin alpha 8)
  Uniprot ID: A9QM74
  ENST ID: ENST00000327442
  CDS Start-End: 41-1591
tgctgtccaacctgcaggtaacttactacttccagtcaatatgccgaccttagatgctccagaagagaggcggagaaaatttaagtaccgaggcaaagatgtgtctctgaggcgacagcagaggatggcggtcagtctggagctccgaaaggccaagaaagatgaacagaccttaaagagaaggaatatcacgagcttctgccctgacacaccttctgaaaaaacagccaaaggggtggcggtcagcctcactctgggtgaaataatcaaaggtgtgaatagctcagatccagtcctatgtttccaggccacccagacagccaggaaaatgctatcccaggaaaagaacccccctctgaaactggtcattgaagcgggcctcattcccaggatggtggagttcctgaagtcatcactttacccctgcttgcagtttgaggctgcctgggccctgaccaacatcgcttcagggacttcggagcagactcgtgccgtggtagaagggggagccatccagcccttgattgagctcctgtcttcctccaacgtggctgtgtgtgaacaggcagtgtgggctcttggtaatatagccggtgatggcccagagttcagagataacgtcatcacaagcaatgccatcccacatctcctagccttgatttcacccaccctgccgatcacatttctgcggaacatcacgtggaccttgtcgaatctgtgccgaaacaagaacccatacccttgcgacactgcggtgaagcagatactgccggccctccttcacctcctgcagcaccaggacagtgaggttctctcggatgcctgctgggcactgtcctacctcaccgacggctccaacaagcgcatcggccaagtggttaacacgggggtcctgcccaggctggtagtgctcatgaccagctcagaactcaatgtcttgactccttctctccgcaccgtggggaacattgtcacgggcacagatgagcagacgcagatggccattgatgcgggtatgctgaacgtgctcccccagctcctgcaacacaacaagccctccatccagaaggaggcagcctgggccctgagcaacgtagcagcggggccttgtcaccacatccagcagctgcttgcctacgacgtcttgcctcccttggtggctctgctaaaaaacggagaatttaaagtccagaaagaggctgtctggatggtggcgaactttgcaacaggggccaccatggatcagctgatccagctcgtccactctggggtcctggagccactggtgaatctgctcactgccccagatgttaaaattgttctcatcatccttgatgtcatctcttgcatcctccaggcggcagagaaacggtctgagaaggaaaacctgtgtcttctgatagaagaacttggtgggatcgatagaattgaggctttacagctgcatgagaaccgtcaaattggccagtcggctttgaacatcatcgagaagcactttggtgaggaagaagatgagagccaaactttactgagccaagtcatagaccaagattatgaatttatagattatgaatgcttagcaaaaaaatagccaagctccctacctcctaaaccaacaacccagtgctaaaggataacttctttaagaagcagcagtcctctatcttagtgtaacccaaatgtgaagcttttaaaacttgacattaataaaatgttcaacacttt

SEQ ID NO: 145038 - DNA, 5309 bp, Homo sapiens
  Payload ID: 8663
  Gene Symbol: KANSL1
  Gene Name: KAT8 regulatory NSL complex subunit 1
  Uniprot ID: Q7Z3B3
  ENST ID: ENST00000262419
  CDS Start-End: 472-3789
tcctcctcctcctgctgccctttctccttctcctcgctctccctgtggctcccatttctctctctctttgttagttgtaactagaaaggcagggcagggtagaaaaatcccccggaactttaaatggcctctccgggcttccctgctgcgggtccgggctgggagtcgccccaagggcgggggtgtgcgggggcccttccccaggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaa

SEQ ID NO: 145039 - DNA, 5080 bp, Homo sapiens
  Payload ID: 8663
  Gene Symbol: KANSL1
  Gene Name: KAT8 regulatory NSL complex subunit 1
  Uniprot ID: Q7Z3B3
  ENST ID: ENST00000432791
  CDS Start-End: 258-3572
cgcccccacttctaggcttggttgaaccgtgcagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgctt

SEQ ID NO: 145040 - DNA, 586 bp, Homo sapiens
  Payload ID: 8663
  Gene Symbol: KANSL1
  Gene Name: KAT8 regulatory NSL complex subunit 1
  ENST ID: ENST00000571698
  CDS Start-End: 220-586
tactacacagtgcaaacagttcctcgctcacgtcctctcgctccgcggcgccggcccgccctgcccctcaactggcgagccgcaccgccggccccagcacggagggcatgtgacggcgtcagtgcctcagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctg

SEQ ID NO: 145041 - DNA, 667 bp, Homo sapiens
  Payload ID: 8663
  Gene Symbol: KANSL1
  Gene Name: KAT8 regulatory NSL complex subunit 1
  ENST ID: ENST00000574655
  CDS Start-End: 251-667
acttctaggcttggttgaaccgtgcagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttaga

SEQ ID NO: 145042 - DNA, 404 bp, Homo sapiens
  Payload ID: 8663
  Gene Symbol: KANSL1
  Gene Name: KAT8 regulatory NSL complex subunit 1
  ENST ID: ENST00000576739
  CDS Start-End: 378-404
ctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcact

SEQ ID NO: 145043 - DNA, 4711 bp, Homo sapiens
  Payload ID: 8663
  Gene Symbol: KANSL1
  Gene Name: KAT8 regulatory NSL complex subunit 1
  ENST ID: ENST00000575318
  CDS Start-End: 35-3160
gggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccatgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaa

SEQ ID NO: 145044 - DNA, 5014 bp, Homo sapiens
  Payload ID: 8663
  Gene Symbol: KANSL1
  Gene Name: KAT8 regulatory NSL complex subunit 1
  Uniprot ID: Q7Z3B3
  ENST ID: ENST00000572904
  CDS Start-End: 174-3491
cggcgcccaggccggggggctgtttgcaaactgcgcccattttgtggggctgaatccgcccgggctacgctcctccatcacgtgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaa

SEQ ID NO: 145045 - DNA, 5105 bp, Homo sapiens
  Payload ID: 8663
  Gene Symbol: KANSL1
  Gene Name: KAT8 regulatory NSL complex subunit 1
  Uniprot ID: Q7Z3B3
  ENST ID: ENST00000574590
  CDS Start-End: 228-3545
tcagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaa

SEQ ID NO: 145046 - DNA, 4735 bp, Homo sapiens
  Payload ID: 8663
  Gene Symbol: KANSL1
  Gene Name: KAT8 regulatory NSL complex subunit 1
  ENST ID: ENST00000611596
  CDS Start-End: 92-3409
agtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcttctgtcaattccatggaacagccggcacttcaaggaagcagtaggttatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccgcttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagatccagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcattcgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccactgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggcagagggctacagtttagcatggccttcttgagctagggtggaatggggcagggtgctctggactcttaccccctcccctcccatctgtggcttggctctgctgtggccctcctggctgggtccccttggttttttgtgctggaacatccccaccagagcctctctgccataactgccagctgctctccccgagtgctcagctggcagaacacctttcctttctcacccagaacttaagagactgattttttgtttcatctgcatttggtcttctctgttttgactctctcactgcagtaacctggctgtggctgctcaggttcccctcctcatgccccttggtacccttccctgtctgctctcccatgccatgtacacacccacaacccatccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaaatacaataatgcaccatatccctatgcataaagtgcttcttctatttataaggttgaaaattctgaataacccttttagcattg

SEQ ID NO: 145047 - DNA, 5080 bp, Homo sapiens
  Payload ID: 8663
  Gene Symbol: KANSL1
  Gene Name: KAT8 regulatory NSL complex subunit 1
  ENST ID: ENST00000613150
  CDS Start-End: 258-3572
cgcccccacttctaggcttggttgaaccgtgcagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactctgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgctt

SEQ ID NO: 145048 - DNA, 5014 bp, Homo sapiens
  Payload ID: 8663
  Gene Symbol: KANSL1
  Gene Name: KAT8 regulatory NSL complex subunit 1
  ENST ID: ENST00000622036
  CDS Start-End: 174-3491
cggcgcccaggccggggggctgtttgcaaactgcgcccattttgtggggctgaatccgcccgggctacgctcctccatcacgtgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactctgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaa

SEQ ID NO: 145049 - DNA, 5309 bp, Homo sapiens
  Payload ID: 8663
  Gene Symbol: KANSL1
  Gene Name: KAT8 regulatory NSL complex subunit 1
  ENST ID: ENST00000610328
  CDS Start-End: 472-3789
tcctcctcctcctgctgccctttctccttctcctcgctctccctgtggctcccatttctctctctctttgttagttgtaactagaaaggcagggcagggtagaaaaatcccccggaactttaaatggcctctccgggcttccctgctgcgggtccgggctgggagtcgccccaagggcgggggtgtgcgggggcccttccccaggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactctgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaa

SEQ ID NO: 145050 - DNA, 5110 bp, Homo sapiens
  Payload ID: 8663
  Gene Symbol: KANSL1
  Gene Name: KAT8 regulatory NSL complex subunit 1
  ENST ID: ENST00000627698
  CDS Start-End: 228-3545
tcagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcttctgtcaattccatggaacagccggcacttcaaggaagcagtaggttatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccgcttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagatccagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcattcgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccactgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggcagagggctacagtttagcatggccttcttgagctagggtggaatggggcagggtgctctggactcttaccccctcccctcccatctgtggcttggctctgctgtggccctcctggctgggtccccttggttttttgtgctggaacatccccaccagagcctctctgccataactgccagctgctctccccgagtgctcagctggcagaacacctttcctttctcacccagaacttaagagactgattttttgtttcatctgcatttggtcttctctgttttgactctctcactgcagtaacctggctgtggctgctcaggttcccctcctcatgccccttggtacccttccctgtctgctctcccatgccatgtacacacccacaacccatccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaaatacaataatgcaccatatccctatgcataaagtgcttcttctatttataaggttgaaaattctgaataacccttttagcattgaaaaaaaaacaaaaacaaaaaatggaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaagaaggaaaaattgaaaaaaataaaaaaaaaagttacagaa

SEQ ID NO: 145051 - DNA, 4716 bp, Homo sapiens
  Payload ID: 8663
  Gene Symbol: KANSL1
  Gene Name: KAT8 regulatory NSL complex subunit 1
  ENST ID: ENST00000630200
  CDS Start-End: 35-3160
gggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcttctgtcaattccatggaacagccggcacttcaaggaagcagtaggttatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccgcttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagatccagctcgtaaggacaggcacaaattggtcagctccttcctaacaacagccatgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagccagtaaggaggagaaggggagagagctcattcgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccactgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggcagagggctacagtttagcatggccttcttgagctagggtggaatggggcagggtgctctggactcttaccccctcccctcccatctgtggcttggctctgctgtggccctcctggctgggtccccttggttttttgtgctggaacatccccaccagagcctctctgccataactgccagctgctctccccgagtgctcagctggcagaacacctttcctttctcacccagaacttaagagactgattttttgtttcatctgcatttggtcttctctgttttgactctctcactgcagtaacctggctgtggctgctcaggttcccctcctcatgccccttggtacccttccctgtctgctctcccatgccatgtacacacccacaacccatccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaaatacaataatgcaccatatccctatgcataaagtgcttcttctatttataaggttgaaaattctgaataacccttttagcattgaaaaaaaaacaaaaacaaaaaatggaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaagaaggaaaaattgaaaaaaataaaaaaaaaa

SEQ ID NO: 145052 - DNA, 5314 bp, Homo sapiens
  Payload ID: 8663
  Gene Symbol: KANSL1
  Gene Name: KAT8 regulatory NSL complex subunit 1
  ENST ID: ENST00000626533
  CDS Start-End: 472-3789
tcctcctcctcctgctgccctttctccttctcctcgctctccctgtggctcccatttctctctctctttgttagttgtaactagaaaggcagggcagggtagaaaaaacccccggaactttaaatggcctctccgggcttccctgctgcgggtccgggctgggagtcgccccaagggcgggggtgtgcgggggcccttcccctggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcttctgtcaattccatggaacagccggcacttcaaggaagcagtaggttatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccgcttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagatccagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcattcgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccactgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggcagagggctacagtttagcatggccttcttgagctagggtggaatggggcagggtgctctggactcttaccccctcccctcccatctgtggcttggctctgctgtggccctcctggctgggtccccttggttttttgtgctggaacatccccaccagagcctctctgccataactgccagctgctctccccgagtgctcagctggcagaacacctttcctttctcacccagaacttaagagactgattttttgtttcatctgcatttggtcttctctgttttgactctctcactgcagtaacctggctgtggctgctcaggttcccctcctcatgccccttggtacccttccctgtctgctctcccatgccatgtacacacccacaacccatccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaaatacaataatgcaccatatccctatgcataaagtgcttcttctatttataaggttgaaaattctgaataacccttttagcattgaaaaaaaaacaaaaacaaaaaatggaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaa

SEQ ID NO: 145053 - DNA, 404 bp, Homo sapiens; identical to SEQ ID NO: 145042
  Payload ID: 8663
  Gene Symbol: KANSL1
  Gene Name: KAT8 regulatory NSL complex subunit 1
  ENST ID: ENST00000628726
  CDS Start-End: 378-404

SEQ ID NO: 145054 - DNA, 5016 bp, Homo sapiens
  Payload ID: 8663
  Gene Symbol: KANSL1
  Gene Name: KAT8 regulatory NSL complex subunit 1
  ENST ID: ENST00000629551
  CDS Start-End: 174-3491
cggcgcccaggccggggggctgtttgcaaactgcgcccattttgtggggctgaatccgcccgggctacgctcctccatcacgtgtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcttctgtcaattccatggaacagccggcacttcaaggaagcagtaggttatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccgcttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagatccagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcattcgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgatgcagcctttgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccactgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggcagagggctacagtttagcatggccttcttgagctagggtggaatggggcagggtgctctggactcttaccccctcccctcccatctgtggcttggctctgctgtggccctcctggctgggtccccttggttttttgtgctggaacatccccaccagagcctctctgccataactgccagctgctctccccgagtgctcagctggcagaacacctttcctttctcacccagaacttaagagactgattttttgtttcatctgcatttggtcttctctgttttgactctctcactgcagtaacctggctgtggctgctcaggttcccctcctcatgccccttggtacccttccctgtctgctctcccatgccatgtacacacccacaacccatccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaaatacaataatgcaccatatccctatgcataaagtgcttcttctatttataaggttgaaaattctgaataacccttttagcattgaaaaaaaaacaaaaacaaaaaatggaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaa

SEQ ID NO: 145055 - DNA, 667 bp, Homo sapiens; identical to SEQ ID NO: 145041
  Payload ID: 8663
  Gene Symbol: KANSL1
  Gene Name: KAT8 regulatory NSL complex subunit 1
  ENST ID: ENST00000626557
  CDS Start-End: 251-667

SEQ ID NO: 145056 - DNA, 586 bp, Homo sapiens
  Payload ID: 8663
  Gene Symbol: KANSL1
  Gene Name: KAT8 regulatory NSL complex subunit 1
  ENST ID: ENST00000629079
  CDS Start-End: 220-586
tactacacagtgcaaacagttcctcgctcacgtcctctcgctccgcggcgccggcccgccctgcccctcaactggcgagccgcaccgccggcctcagcacggagggcatgtgacggcgtcagtgcctcagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctg

SEQ ID NO: 145057 - DNA, 4711 bp, Homo sapiens
  Payload ID: 8663
  Gene Symbol: KANSL1
  Gene Name: KAT8 regulatory NSL complex subunit 1
  ENST ID: ENST00000633346
  CDS Start-End: 35-3160
gggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccatgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactctgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaa

SEQ ID NO: 145058 - DNA, 667 bp, Homo sapiens; identical to SEQ ID NO: 145041
  Payload ID: 8663
  Gene Symbol: KANSL1
  Gene Name: KAT8 regulatory NSL complex subunit 1
  ENST ID: ENST00000632215
  CDS Start-End: 251-667

SEQ ID NO: 145059 - DNA, 5105 bp, Homo sapiens
  Payload ID: 8663
  Gene Symbol: KANSL1
  Gene Name: KAT8 regulatory NSL complex subunit 1
  ENST ID: ENST00000633819
  CDS Start-End: 228-3545
tcagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactctgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaa

SEQ ID NO: 145060 - DNA, 586 bp, Homo sapiens; identical to SEQ ID NO: 145040
  Payload ID: 8663
  Gene Symbol: KANSL1
  Gene Name: KAT8 regulatory NSL complex subunit 1
  ENST ID: ENST00000633540
  CDS Start-End: 220-586

SEQ ID NO: 145061 - DNA, 404 bp, Homo sapiens; identical to SEQ ID NO: 145042
  Payload ID: 8663
  Gene Symbol: KANSL1
  Gene Name: KAT8 regulatory NSL complex subunit 1
  ENST ID: ENST00000633448
  CDS Start-End: 378-404

SEQ ID NO: 145062 - DNA, 4754 bp, Homo sapiens
  Payload ID: 8664
  Gene Symbol: KANSL1L
  Gene Name: KAT8 regulatory NSL complex subunit 1-like
  Uniprot ID: A0AUZ9
  ENST ID: ENST00000281772
  CDS Start-End: 265-3228
gagccgcacggagctgcgggcagcgggcggactgttaaaccgcggcggcggcggcggcggcggcggcggcggcggcggcggcggcggccggggcgggagcggggcgcgctctggagacgagtcagcggcgccccgggtgggggaggcgggcgggcagctagagatcacctcagcagcccccaccacggccggaccgaaggtgcggcggcggaggggagccagggcgccccagcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagtgcatcagagaatttagatgagctgtcttcctccagtagctggttacttaaccagaagcacagtaagaaaaagagaaaagacaggacaagactgaaatcttcatccttgactttcatgagtacatcagcccgaacaaggccacttcagagtttccacaaacgaaaactgtacagattgagccctactttttattggactccacagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctgtacatagtactctgaatcaatggagaaatggatattcacctatatgtaagcctcaaataaggtcagaatcttctgcacaactgttacagggaagaaagaaaagacatttgagtgaaacagcattaggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttggaaatgcatgtatgaactaccctatgaaatgtaagctgcagaatagataaaacacaggtttccactaataaaagacatctgaacgtcctgaatatagagacagaagttttttgttgttgttgttgttgttttaacatgtttaaccaacagaagttatttacagaaattcatatatccaggcaacacaaaactcctttattcaaaatcactgctatctttgggactaaacacaggctactttctgtttactcctaacaaaataaagcaagcaaatttgagtcaaatattggtgcactttaatactatcacatctttgaaaactcaatttgagttttaccaattaatgtgtctcatgaagagaagacaccagttttaaaatgagccacaaacagtaaagccctatcagtataaaatttgaaaaaaaaaaaaaagatgattgtatttctagattagcaagaaattagttaattctggctgatttctatttctagctaatttggtcattctttgccatagcttactctattcaaataaacatatattcttgcttgcatcctagattggaaattaaaatttttcaaagaacaaagcttcaatattggatactgaagagtatacatgaaagaaaattccttttgaagctattaaaccatttttttcctatgtgaaagttgaggacaatttatataactcactttttgtcatgtaaaaaaggttactcaagttgtactacccacataactgaaaatattggccatttggccttatctgtgagatttgacactaagtttttgttagagattggaaattatactagtccttttaaggggtaaaaaattcaattcaatactgacaaacttttgcttgtagttttactgtacatttatttttaaagaaaaagaaaacaaaagccagacaaacccaagttgtccaggcaaataaactcaaatctttgtcacgtctgatattataatcttctatgtaagttttttaattaaagttatttctatat

SEQ ID NO: 145063 - DNA, 668 bp, Homo sapiens
  Payload ID: 8664
  Gene Symbol: KANSL1L
  Gene Name: KAT8 regulatory NSL complex subunit 1-like
  ENST ID: ENST00000415553
  CDS Start-End: 1-599
tgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacaggtaaagtcaaagtaaggatatcagtggtatgaaatgacttttcattgattttgtaaactattcaaataaacatcattatatgtg

SEQ ID NO: 145064 - DNA, 2264 bp, Homo sapiens
  Payload ID: 8664
  Gene Symbol: KANSL1L
  Gene Name: KAT8 regulatory NSL complex subunit 1-like
  Uniprot ID: A0AUZ9
  ENST ID: ENST00000457374
  CDS Start-End: 139-2256
gtagctgggattacagttgcccaccaccatgcccggctaatttttatatttttagtagagacagagtttcaccatgttggccatgctgatctcgaactcctgatctcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagtgcatcagagaatttagatgagctgtcttcctccagtagctggttacttaaccagaagcacagtaagaaaaagagaaaagacaggacaagactgaaatcttcatccttgactttcatgagtacatcagcccgaacaaggccacttcagagtttccacaaacgaaaactgtacagattgagccctactttttattggactccacagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctggtatgtcacatttacagttcttgtactctatatgcctttttatgtctttatacttactatttttgcattctaagaaaaataaaatctaagaaaagaa

SEQ ID NO: 145065 - DNA, 2334 bp, Homo sapiens
  Payload ID: 8664
  Gene Symbol: KANSL1L
  Gene Name: KAT8 regulatory NSL complex subunit 1-like
  Uniprot ID: A0AUZ9
  ENST ID: ENST00000452086
  CDS Start-End: 209-2326
gcggcggcggcggcggcggcggcggcggcggccggggcgggagcggggcgcgctctggagacgagtcagcggcgccccgggtgggggaggcgggcgggcagctagagatcacctcagcagcccccaccacggccggaccgaaggtgcggcggcggaggggagccagggcgccccagcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagtgcatcagagaatttagatgagctgtcttcctccagtagctggttacttaaccagaagcacagtaagaaaaagagaaaagacaggacaagactgaaatcttcatccttgactttcatgagtacatcagcccgaacaaggccacttcagagtttccacaaacgaaaactgtacagattgagccctactttttattggactccacagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctggtatgtcacatttacagttcttgtactctatatgcctttttatgtctttatacttactatttttgcattctaagaaaaataaaatctaagaaaagaa

SEQ ID NO: 145066 - DNA, 1510 bp, Homo sapiens
  Payload ID: 8664
  Gene Symbol: KANSL1L
  Gene Name: KAT8 regulatory NSL complex subunit 1-like
  ENST ID: ENST00000428655
  CDS Start-End: 1-1030
ggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagtgcatcagagaatttagatgagctgtcttcctccagtagctggttacttaaccagaagcacagtaagaaaaagagaaaagacaggacaagactgaaatcttcatccttgactttcatgagtacatcagcccgaacaaggccacttcagagtttccacaaacgaaaactgtacagattgagccctactttttattggactccacagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcaggtaagcctccttgtaacaatttctaagtaacgatattttctgtactgaaatctaatcctctaaatacagagaatctaataaatcttattttatcaattttttttcagtagatattagaactaagcaatgccttgacaattaaatttgttgtagaggaattaatctagtcacatgcacggttaatgttctatctgtgtaagttgattctttaattccttctaaaccaacttgatttactttgggaaattactaggtttttatcttgttaaattttgagcattttattggtaacatggctgtgctgttgaaatgtttctgagtaatggtaattcagtgttctttttctaatgtgctgttatacatggaggtttccctgtcataaaatatttctccatttataatctgcattgaatttctcaatgcagagggaagaaaactgcgtacctataagtatagtcaacctcaagagtatctgtactttataactgagtaaatgaggcttatac

SEQ ID NO: 145067 - DNA, 3562 bp, Homo sapiens
  Payload ID: 8664
  Gene Symbol: KANSL1L
  Gene Name: KAT8 regulatory NSL complex subunit 1-like
  Uniprot ID: A0AUZ9
  ENST ID: ENST00000418791
  CDS Start-End: 209-3046
gcggcggcggcggcggcggcggcggcggcggccggggcgggagcggggcgcgctctggagacgagtcagcggcgccccgggtgggggaggcgggcgggcagctagagatcacctcagcagcccccaccacggccggaccgaaggtgcggcggcggaggggagccagggcgccccagcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagtgcatcagagaatttagatgagctgtcttcctccagtagctggttacttaaccagaagcacagtaagaaaaagagaaaagacaggacaagactgaaatcttcatccttgactttcatgagtacatcagcccgaacaaggccacttcagagtttccacaaacgaaaactgtacagattgagccctactttttattggactccacagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttgga

SEQ ID NO: 145068 - DNA, 808 bp, Homo sapiens
  Payload ID: 8664
  Gene Symbol: KANSL1L
  Gene Name: KAT8 regulatory NSL complex subunit 1-like
  ENST ID: ENST00000438563
  CDS Start-End: 1-575
ctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggaggtaggtatcaatggaatagcttagcttttaaattcaactttgcctattttatcttattttgattttgttttgatattttaagtattatagctactttttttgtacattaggggctactagagtacaatcaatataccatggatgcattttttgataatattaaatttacacaattaaggtaatgataaatctaggaatgagggagagagatttctgggaagtttcataatgtttctt

SEQ ID NO: 145069 - DNA, 547 bp, Homo sapiens
  Payload ID: 8664
  Gene Symbol: KANSL1L
  Gene Name: KAT8 regulatory NSL complex subunit 1-like
  ENST ID: ENST00000634716
  CDS Start-End: 1-211
acgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatttttggattttggaattgcagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttat

SEQ ID NO: 145070 - DNA, 2155 bp, Homo sapiens
  Payload ID: 8665
  Gene Symbol: KANSL2
  Gene Name: KAT8 regulatory NSL complex subunit 2
  Uniprot ID: Q9H9L4
  ENST ID: ENST00000420613
  CDS Start-End: 49-1527
gagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacccagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtca

SEQ ID NO: 145071 - DNA, 343 bp, Homo sapiens
  Payload ID: 8665
  Gene Symbol: KANSL2
  Gene Name: KAT8 regulatory NSL complex subunit 2
  ENST ID: ENST00000548304
  CDS Start-End: 135-343
cggcagagtgcggcgcagcgcagctcctgaggcttccaggagccaggatctccggtgactggagccgtaggacaaaatggcgctcgcataggcttccgaggccaggcccagtcgtgcgctctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaa

SEQ ID NO: 145072 - DNA, 1514 bp, Homo sapiens
  Payload ID: 8665
  Gene Symbol: KANSL2
  Gene Name: KAT8 regulatory NSL complex subunit 2
  ENST ID: ENST00000548147
  CDS Start-End: 1-77
ctccagaaagtagtcgcagtgaagccagccgaatactagacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggacttggatgttgtgggtgatggtatgcagtgtcctccttcacctttgctttttgatccttcactaacccttgaagatcatttagtcaaagaaattgctgaagacccagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgca

SEQ ID NO: 145073 - DNA, 831 bp, Homo sapiens
  Payload ID: 8665
  Gene Symbol: KANSL2
  Gene Name: KAT8 regulatory NSL complex subunit 2
  ENST ID: ENST00000547087
  CDS Start-End: 1-621
gagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggacttggatgttgtgggtgatggtatgcagtgtcctccttcacctttgctttttgatccttcactaacccttgaagatcatttagtcaaagaaattgctgaagacccagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatcc

SEQ ID NO: 145074 - DNA, 461 bp, Homo sapiens
  Payload ID: 8665
  Gene Symbol: KANSL2
  Gene Name: KAT8 regulatory NSL complex subunit 2
  ENST ID: ENST00000550931
  CDS Start-End: 62-461
actagagaagggcgagcggcgcggcagagtgcggcgcagcgcagctcctgaggttttggttatgaacaggattcggattcacgtcttgccaaccaatcgggggaggatcactccagtgcccagggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgc

SEQ ID NO: 145075 - DNA, 1881 bp, Homo sapiens
  Payload ID: 8665
  Gene Symbol: KANSL2
  Gene Name: KAT8 regulatory NSL complex subunit 2
  Uniprot ID: Q9H9L4
  ENST ID: ENST00000546701
  CDS Start-End: 35-502
agtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccagaaagatgcgactgccattggtgacctgttaactctttactgtggtctaatggagacagcactcgactgaaagtgaaggacccagactctagttgacttggatgttgtgggtgatggtatgcagtgtcctccttcacctttgctttttgatccttcactaacccttgaagatcatttagtcaaagaaattgctgaagacccagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgc

SEQ ID NO: 145076 - DNA, 593 bp, Homo sapiens
  Payload ID: 8665
  Gene Symbol: KANSL2
  Gene Name: KAT8 regulatory NSL complex subunit 2
  ENST ID: ENST00000550870
  CDS Start-End: 270-593
actagagaagggcgagcggcgcggcagagtgcggcgcagcgcagctcctgaggcttccaggagccaggatctccggtgactggagccgtaggacaaaatggcgctcgcataggcttccgaggccaggcccagtcgtgcgctctgaggcaggccgggacaaaggcggcgtgcggggaggcggcgtggccgccgcgtggggctggtgttgtcgcttcccttcgtgctgcagctgtgcgagtcctgaagatacattcagcgtggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaaccca

SEQ ID NO: 145077 - DNA, 1830 bp, Homo sapiens
  Payload ID: 8665
  Gene Symbol: KANSL2
  Gene Name: KAT8 regulatory NSL complex subunit 2
  ENST ID: ENST00000553086
  CDS Start-End: 311-1675
ctcttgcggttgggctgctatttcgctctttttgtcagctcagagctgctactccgcctcaaagcagtgtcagagtcagtctccttcctgcaggcttccaggagccaggatctccggtgactggagccgtaggacaaaatggcgctcgcataggcttccgaggccaggcccagtcgtgcgctctgaggcaggccgggacaaaggcggcgtgcggggaggcggcgtggccgccgcgtggggctggtgttgtcgcttcccttcgtgctgcagctgtgcgagtcctgaagatacattcagcgtggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggacttggatgttgtgggtgatggtatgcagtgtcctccttcacctttgctttttgatccttcactaacccttgaagatcatttagtcaaagaaattgctgaagacccaggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgagga

SEQ ID NO: 145078 - DNA, 581 bp, Homo sapiens
  Payload ID: 8665
  Gene Symbol: KANSL2
  Gene Name: KAT8 regulatory NSL complex subunit 2
  ENST ID: ENST00000547582
  CDS Start-End: 1-225
cccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactaggtttgggttgataaaagtaatctagttttgtgtggtggagttacagaggtgggaagtcttaatggctgctctcccttccttgcctcagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctag

SEQ ID NO: 145079 - DNA, 2714 bp, Homo sapiens
  Payload ID: 8665
  Gene Symbol: KANSL2
  Gene Name: KAT8 regulatory NSL complex subunit 2
  ENST ID: ENST00000550347
  CDS Start-End: 45-2072
gagcggcgcggcagagtgcggcgcagcgcagctcctgaggtaagatggcggtgctctttcctctaagctcttgcggttgggctgctatttcgctctttttgtcagctcagagctgctactccgcctcaaagcagtgtcagagtcagtctccttcctgcaggcttccaggagccaggatctccggtgactggagccgtaggacaaaatggcgctcgcataggcttccgaggccaggcccagtcgtgcgctctgaggcaggccgggacaaaggcggcgtgcggggaggcggcgtggccgccgcgtggggctggtgttgtcgcttcccttcgtgctgcagctgtgcgagtcctgaagatacattcagcgtggtgtggttcggggtggggccgggcatggagggacacgctaaagggaggcaaagccacagatgcctgtggagacttggggagggcggcggggacttacggagcgtaccttacggggacgacttctgcatgtcctttggaaactgtccgcgcgatctgtgtggagcaggaattttcgggaagggtaagggctttttggtctttcgtttgaccccgcaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacccagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgc

SEQ ID NO: 145080 - DNA, 1625 bp, Homo sapiens
  Payload ID: 8665
  Gene Symbol: KANSL2
  Gene Name: KAT8 regulatory NSL complex subunit 2
  ENST ID: ENST00000549574
  CDS Start-End: 1-1022
tcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccagaaagatgcgactgccattggtgacctgttaactctttactgtggtctaatggagacagcactcgactgaaagtgaaggacccagactctagttatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggacttggatgttgtgggtgatggtatgcagtgtcctccttcacctttgctttttgatccttcactaacccttgaagatcatttagtcaaagaaattgctgaagacccagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttc

SEQ ID NO: 145081 - DNA, 5253 bp, Homo sapiens
  Payload ID: 8666
  Gene Symbol: KANSL3
  Gene Name: KAT8 regulatory NSL complex subunit 3
  ENST ID: ENST00000354204
  CDS Start-End: 115-333
aggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaca

SEQ ID NO: 145082 - DNA, 5012 bp, Homo sapiens
  Payload ID: 8666
  Gene Symbol: KANSL3
  Gene Name: KAT8 regulatory NSL complex subunit 3
  ENST ID: ENST00000447759
  CDS Start-End: 1-282
agtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagggtctcactctgtcacccagactgcagtgcagtggcacgatctcagctcactacaagccttgacctccaggactcagtctccttgtggaccaccacccttctgttatgacattgccacattgccacagattgatgcttacacaccatctcttttggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaa

SEQ ID NO: 145083 - DNA, 5153 bp, Homo sapiens
  Payload ID: 8666
  Gene Symbol: KANSL3
  Gene Name: KAT8 regulatory NSL complex subunit 3
  Uniprot ID: Q9P2N6
  ENST ID: ENST00000431828
  CDS Start-End: 78-2714
gccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccattgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaa

SEQ ID NO: 145084 - DNA, 1448 bp, Homo sapiens
  Payload ID: 8666
  Gene Symbol: KANSL3
  Gene Name: KAT8 regulatory NSL complex subunit 3
  ENST ID: ENST00000452268
  CDS Start-End: 100-330
cgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcag

SEQ ID NO: 145085 - DNA, 701 bp, Homo sapiens
  Payload ID: 8666
  Gene Symbol: KANSL3
  Gene Name: KAT8 regulatory NSL complex subunit 3
  ENST ID: ENST00000448075
  CDS Start-End: 184-701
agggatccggccgtggccgagcgcgcggccgtaagaccgcgggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtaagtaatttctatcttatttggaggttgtcctgggatggaataccact

SEQ ID NO: 145086 - DNA, 552 bp, Homo sapiens
  Payload ID: 8666
  Gene Symbol: KANSL3
  Gene Name: KAT8 regulatory NSL complex subunit 3
  ENST ID: ENST00000416138
  CDS Start-End: 143-370
actcggtgcccgcagcgccggggcgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgttt

SEQ ID NO: 145087 - DNA, 1526 bp, Homo sapiens
  Payload ID: 8666
  Gene Symbol: KANSL3
  Gene Name: KAT8 regulatory NSL complex subunit 3
  ENST ID: ENST00000425656
  CDS Start-End: 94-312
ttaggatattggaattgacctaaactgaaacttttcactgcaggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaaggtcattttgaccttttgtgggtagcatggaattcgcagatatttcttctcagtatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcag

SEQ ID NO: 145088 - DNA, 5028 bp, Homo sapiens
  Payload ID: 8666
  Gene Symbol: KANSL3
  Gene Name: KAT8 regulatory NSL complex subunit 3
  Uniprot ID: Q9P2N6
  ENST ID: ENST00000420155
  CDS Start-End: 100-2442
cgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccattgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagcacagtttgctgcttttctgaaacaaaatatgctggtgaggaaagctcttcctcctggcacctcctcctgtctctttgttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaac

SEQ ID NO: 145089 - DNA, 2717 bp, Homo sapiens
  Payload ID: 8666
  Gene Symbol: KANSL3
  Gene Name: KAT8 regulatory NSL complex subunit 3
  ENST ID: ENST00000444759
  CDS Start-End: 147-611
ttttactcggtgcccgcagcgccggggcgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccattgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctcctt

SEQ ID NO: 145090 - DNA, 594 bp, Homo sapiens
  Payload ID: 8666
  Gene Symbol: KANSL3
  Gene Name: KAT8 regulatory NSL complex subunit 3
  ENST ID: ENST00000418735
  CDS Start-End: 92-295
ctttttggagctcctcagtccaagacttttcccagcgatcctgggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtg

SEQ ID NO: 145091 - DNA, 693 bp, Homo sapiens
  Payload ID: 8666
  Gene Symbol: KANSL3
  Gene Name: KAT8 regulatory NSL complex subunit 3
  ENST ID: ENST00000451819
  CDS Start-End: 58-456
actgcaggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccattgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaagg

SEQ ID NO: 145092 - DNA, 2811 bp, Homo sapiens
  Payload ID: 8666
  Gene Symbol: KANSL3
  Gene Name: KAT8 regulatory NSL complex subunit 3
  ENST ID: ENST00000597150
  CDS Start-End: 89-553
atccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccattgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagcacagtttgctgcttttctgaaacaaaatatgctggtgaggaaagctcttcctcctggcacctcctcctgtctctttgttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcgg

SEQ ID NO: 145093 - DNA, 1684 bp, Homo sapiens
  Payload ID: 8667
  Gene Symbol: KATNA1
  Gene Name: katanin p60 (ATPase containing) subunit A 1
  Uniprot ID: O75449
  ENST ID: ENST00000335647
  CDS Start-End: 46-1521
taaagtgtttctttttttcttcttctttttagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagatttttttaaaaaaacccttatgattctgaataaaggcaatatttttaagctgaaaa

SEQ ID NO: 145094 - DNA, 1564 bp, Homo sapiens
  Payload ID: 8667
  Gene Symbol: KATNA1
  Gene Name: katanin p60 (ATPase containing) subunit A 1
  Uniprot ID: O75449
  ENST ID: ENST00000335643
  CDS Start-End: 281-1216
gggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagatttttttaaaaaaacccttatgattctgaataaaggcaatatttttaagctgaaaa

SEQ ID NO: 145095 - DNA, 1984 bp, Homo sapiens
  Payload ID: 8667
  Gene Symbol: KATNA1
  Gene Name: katanin p60 (ATPase containing) subunit A 1
  Uniprot ID: O75449
  ENST ID: ENST00000367411
  CDS Start-End: 350-1825
atgcgcacgcgcggccccgggcccggccacaccctcttccgccgctcccgcccagcgacctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagatttttttaaaaaaacccttatgattctgaataaaggcaatatttttaagctg

SEQ ID NO: 145096 - DNA, 1138 bp, Homo sapiens
  Payload ID: 8667
  Gene Symbol: KATNA1
  Gene Name: katanin p60 (ATPase containing) subunit A 1
  ENST ID: ENST00000444282
  CDS Start-End: 297-1138
agcgacctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaa

SEQ ID NO: 145097 - DNA, 716 bp, Homo sapiens
  Payload ID: 8667
  Gene Symbol: KATNA1
  Gene Name: katanin p60 (ATPase containing) subunit A 1
  ENST ID: ENST00000420200
  CDS Start-End: 84-716
ctgacctcggtgtgtgtgtgagtgtggtgaaaatcaagtgggagggaaagtgagcaagcacctgaacaagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatc

SEQ ID NO: 145098 - DNA, 7551 bp, Homo sapiens
  Payload ID: 8668
  Gene Symbol: KATNAL1
  Gene Name: katanin p60 subunit A-like 1
  Uniprot ID: Q9BW62
  ENST ID: ENST00000380615
  CDS Start-End: 169-1641
cggccgcggctgccatggcaacactacgccgccgccgccttttcacgcacgtcgcgagctaacggactcggcggcggcggcggcggcggcctgcgccccacccgcaccccatctggaccgcatcgctgaatgtgcccggacctgcgccttctgggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgcaatttttaaaaaacaagtttggaatttttttcagtggagtggttttcgcttaaaggaaaaaaaaatctaaaactgcgaagaatactaaatgtagttgagaaataattgatggcgagagtttgctagtctccctccccggctttgtgctggtattccacgtattcctgcattaatattgcacacccaaaccagtctatcagggaggctgaagcaagggcgcagtgtgatattttaggaatacagaagatttagaaatacccctatttctcatttgcagtttttttttccaattctgtgctctgtcaacatgagggacctatctatgtatgttgacttttaacatcaaaattggatttgtgtcaaacattcattgttaagagaagaatgacagtatattttggaggaaataatgaatttactaattaaacctttagaatttatgacttactgttagagtctgtcatatggttagaatttttacttccgctacccctgccatttcttctgctagctacttcataatatcttgagctttactgaggaatattctcacgctctgtggtatttgaatcattttgccaggtcatttctctgtctttagtattttttgctggtgcttcttacatttaatatggaaaggtgggaagaatattactgcattagatgtaattcttcattctagacttccaagtttgttttcacttttttgtgtgtgcgtgaaggagtctgtgtcacccaggctgtgtagtgcagtggttgatcttggctcactgcaacctctgcctcctagattcaagcaattctcctgtctcagcctcccaagtagctgggattacaggtgcgcaccaccatgcctggctgtgttttcacttttctttcaacatgttcaaccagatatatagccattatttttctcagctccagcattgtttgatttttcttgagtttgattttagtatttgagataaatacttttacattctaaacaagtccactctctgtggctaacgcaaaacaaatgaaatctttattgttttccaaacagctagtttaacaaaacagcatcatacatagtgaatgatgttcattggaaaattctaaaatttgtccttgtctaggttgagaacttttacacacactaagataaagatagaaatctgacatgctcactcaattcagcaggaattacacattagaaagaagccagaaaaataaatggcatatatccaatcacaagtaaatgatcctggcgttagtttttatgattacatgtgtctcattaggcaatttatgctttaatggtcaagcttttaaaaatttgtatttgataacatcctgaattctcagtttcgaatagtgcctactggtttaaaactaaaaataatacagctttttggacatttaaccaagatactaagaaggttttttttaaaaaaagagatttgattatttttccctgctaaaaactgtaaatgccttatgttcttttcagataacttaagtctgacctaaactccagtattcatctgatgctgtaaattgcccttctttctgagacacagattataagatgccagatcataagacatcatgattttattgtaattgaattcttcctaaaaattgagaggtttccttttattaacttttaaaataaagaaataagtagtttcattacgattattttgcaaactattgccagtcagaaatgcactttttttttccctgaagttttaggagccgtcactaaaacattagtcttgtgattgttaaaacttgtttgtaatgggttggtgcaaaagtaattgtggtttttccattactttcaatggcaaaaaccgcaattacttttgcaccagcctaacaatagttgattagttagaccttttctgggttttgtattgattatcttggtgtgcatttaattatttttctgaattcttcatggataatgacatagtaattgtgattcttttaataccagttaagcagtatttggcaacttaaacttcctgggagcctaactttactatgttaagtgagtcaggtgtgctttttatttcccttgtttctcattttgccctgtcagtggatggtagatgctttgtatatcttaaatcccttaaaggatcttaaagacatccctcaggtgttctatttaacttttattttattttattttatttatttatttattttgagactgagtcttgctctgtcgcccaggctggagtgcagtggcatgatctcggctcactgcaacttctgcctcccaggttcaagccattctcctgcctcggcctcctgagtagctgggattacagttgccgccacacccggcttatttttttgtatttttagtagaggcagagtttcaccatgttggccaggctagtctcgaactcctgacctcagatgatccgcccacattggcctcccaaagtgctgggattacaggtgtgatccaccgcacctggccctaacttttaatatacaacacacacacacacacacacacacacacacacacacacacacacacacacacacacactatttcagaagacagtgtgttgccttacccagaatgagtgctaggattacaggcgtgagacagacacacatacacacacatacacacacacagagtctttattgcagaagacagtgtgttgccttataggcgtgagacacacacacacacacacacacacacacacacacacacagtctttattgcagaagacagtgtgttgccttaccagaatgagtgcttggattacaggcgtgagccactgtgcccagccctaacttttaatgtacatcacacacacactcacactcacatacacacacacacacacactctgactgtctttattgcagaagacagtgtgttgccttacccagaatgagattgaattgttttgcttcgttttgttttgttattcagtgttgcggtagcagatgcattatcaaaggaaaaatatttggctcctttaattcctctgaaaacatgagtattttgagttctgcagcacaatgactgtaggactaagctaagtctgctttgcagatatctgatcagatagtcccttcattctgtagacgtgtattggttggtccaagacacagtgagtaggagctctgtggaccaagacaaagctggactagagagtacagttcaaacttggcagtttctctaacgactctgtatagcttctggcttctactactgaaacaagagtttagatcactgatggagaggcatagtaatctgtttgtgctttggaaaaatatataaaagtttttttcccctattttttgcactttaaatctgttttgaaattagaactgatatacatttatttgaataatgtgtaactattatggatctattttaatgaacaatttttaccatttcccaagctgcctgtttattataagcatgacatgtttactataaaccttttgcccccataatttctttttttaaaggaaattaatattagtaaaataaacacctctttaatggaagctgcaaccttctagtgatccaagtagacaatagatggtggcatcacagactttatctacacactttcgggtctgaccactacctcccacaatacctagccattttggaaggggaaaacatgcggtggtctagctgtatagctcagggcttaatttcagcttctgagattgtgatgtcatatttcactctcaaaacataggctgaaagcacgaattactcaaaaagtaagcaaaccaatacctggtgaatctatggacagtcatacacatacatcaggggaaaatgtgtgtgtacaacccaaatttacagtatgattgtcattctttgactttgttttgtatagcctgactctgttgaacatgaaattattagtactctaggttttggacagcttgagttcatttgaattccttccttaggaataagtttttatatacactgctaaatgtgtgatgagaatcataaaacactaaccagctgaggtagctgtgattcactttccccccaccctaacttgagataaaatgaaggactaggcaagtatttcatgttgtgtgagtggacttcggttccttcagtattgtctaggttattgagtctttctttgcctaatagtggattcccactcttaagataacttttattagtgataaatcagtttagggtatattctgtatgacaggcataaaatgttaagggtgaatgctggccttttccaagaaaaggccaccttaacttgtatgaggaaaaaatcctaactattctcttttttgtatctttttttccgtaactgttttgattgtatattttaaagaaaccacttaatttgtgatgcacgtaatatttgtgtgaacctgagaatatgtcacaataggaaaaagcagaaattatacttaggggacatgttaggggggtaaaaatatttaagcctcgaatgttttactgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagtgacttattaataaaaacaggaaaaatatttaggtaatgtcataaaatttattttacctttctcattttctgagaaaataaatgaaaaaaaccctagatattgctttattaccaacagtgtgtaggtttttgtacatatggaaatttgacacaaaaaaatagggaatttgtatagagaagtttccctcttataaaaggactcccatttgattgttcgaaactataaaatgcacttttactttaccatatctgaaatgacaaaatatcgccctttggaaaacctgactctttgcacgtgtaattcccagagtctacctcagttaaccaggcttagttttaggcaggaatgaattgaattaaattcagttcatcatctatgcagatttgtttcttttaagcacatccttccctcctgctgttgccctcctcccattaacttttctttttaatcttgaaattgtttaaaatattccatctttctttctctagcaaagtgtttgtattccaaataaggcctctgtgaaatgtctgaattacttttcccgtctttgttatggtcagcttcattatttggatgtattgcattcaaagcagcagttccaaacataacacacatctattttcttagagttttgtaaatacaaactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggttatatttggtaataaatttatagagtgttggttgtca

SEQ ID NO: 145099 - DNA, 1634 bp, Homo sapiens
  Payload ID: 8668
  Gene Symbol: KATNAL1
  Gene Name: katanin p60 subunit A-like 1
  Uniprot ID: Q9BW62
  ENST ID: ENST00000380617
  CDS Start-End: 102-1574
gacagaaaaaaaaatctctctttgtcttgagggggctgttgagtggtcgcggacctgggctctgtgcgttgggaaagggaagtggaggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgc

SEQ ID NO: 145100 - DNA, 566 bp, Homo sapiens
  Payload ID: 8668
  Gene Symbol: KATNAL1
  Gene Name: katanin p60 subunit A-like 1
  ENST ID: ENST00000414289
  CDS Start-End: 108-566
acagtctcagggatgagcagccgcccaagctgcagggcctcgggtcttcggcgcctctgaccctcgcaggttgctgcctttcggtgcagaaccgtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggac

SEQ ID NO: 145101 - DNA, 797 bp, Homo sapiens
  Payload ID: 8668
  Gene Symbol: KATNAL1
  Gene Name: katanin p60 subunit A-like 1
  ENST ID: ENST00000441394
  CDS Start-End: 347-797
aaactttgagcggaccgggacagaaaaaaaaatctctctttgtcttgagggggctgttgagtggtcgcggacctgggctctgtgcgttgggaaagggaagtggaggtgagcctcgggcttcccgccctgtagctgggcccgccccagttgcagcgctcagccccaccccggctgggccaccgccctgcacagtctcagggatgagcagccgcccaagctgcagggcctcgggtcttcggcgcctctgaccctcgcaggttgctgcctttcggtgcagaaccgtatgtatgtcacacattggatgtgagacctgagaaaccgtgttttaacaggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaa

SEQ ID NO: 145102 - DNA, 2833 bp, Homo sapiens
  Payload ID: 8669
  Gene Symbol: KATNAL2
  Gene Name: katanin p60 subunit A-like 2
  Uniprot ID: Q8IYT4
  ENST ID: ENST00000245121
  CDS Start-End: 195-1595
agtaactgactacttttctcccttctctagggtcctagcacagtgtctgatggagctttcctaccagaccctgaaattcacgcatcaggcgcgggaagcggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccgggacatttatctccataatccaaacataaagtggaatgacattattggacttgatgcagccaagcagttagtcaaagaagctgttgtgtatcctataaggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggagactgagggctactcaggctcagatattaagctcgtctgcagggaagcagccatgcggcccgtgaggaagatctttgatgcacttgaaaatcaccagtcagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaaacccctcccaaactaagccccactcagaaatgtcactgagcattctgatgctagagctaatagccagggtgactagcacaccatcaccatcagctgccagtctgattgttttgggttctggcccccaataacatcttttcactcttcacacctcacatccggtgtgctctgcccttctctttccattgccgcagcttctcatcagatccaaagcttaggatggggcacctaagcttcgagaacattcatcccaagtcttccctgctcttaggctcttccccctctccttaaggggttataaacaactagacgcatctctctcagaaacccacaatccgaggcatctactttcaacccttgataaattttgaaggcttctactaagtaatgccacttcttttcccccactagaacttacctatgggaaatcaccttcttttctcttccttgccttgtcttcatcatccctgcagacagactcttcaagaggaaaaacctccagaaagagacactttggatagctaagtatcccaaaggattttacccttttaaacaaaaccaaagcatttttttcggtatcgattattttgagattattctcaaatgcctctttaaacatcatttcatggaaaatgtcaaattgaaaatataccttatttaacaaattgaaaataaaaaagatttcatctca

SEQ ID NO: 145103 - DNA, 1635 bp, Homo sapiens
  Payload ID: 8669
  Gene Symbol: KATNAL2
  Gene Name: katanin p60 subunit A-like 2
  Uniprot ID: Q8IYT4
  ENST ID: ENST00000356157
  CDS Start-End: 19-1635
gtcctagcacagtgtctgatggagctttcctaccagaccctgaaattcacgcatcaggcgcgggaagcgtgcgagatgaggacagaagcacgacgaaaaaatcttctcattttgatttcgcattatttaacacaagaagggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccgggacatttatctccataatccaaacataaagtggaatgacattattggacttgatgcagccaagcagttagtcaaagaagctgttgtgtatcctataaggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggagactgagggctactcaggctcagatattaagctcgtctgcagggaagcagccatgcggcccgtgaggaagatctttgatgcacttgaaaatcaccagtcagaaagcagcgacttacccaggatccagttggatatagtaaccactgccgactttctggatgtgctaactcacaccaagccctccgcaaagaatctggctcagagatactcagactggcaaagagagttcgagtctgtctga

SEQ ID NO: 145104 - DNA, 1023 bp, Homo sapiens
  Payload ID: 8669
  Gene Symbol: KATNAL2
  Gene Name: katanin p60 subunit A-like 2
  ENST ID: ENST00000588433
  CDS Start-End: 1-1023
ggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccagactgagggctactcaggctcagatattaagctcgtctgcagggaagcagccatgcggcccgtgaggaagatctttgatg

SEQ ID NO: 145105 - DNA, 464 bp, Homo sapiens
  Payload ID: 8669
  Gene Symbol: KATNAL2
  Gene Name: katanin p60 subunit A-like 2
  ENST ID: ENST00000586198
  CDS Start-End: 1-387
ccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtggtaagagaccaagagagtaaattttgaatacattttcaggagtcactaagtgcaaataaaaattttatattgaccacttca

SEQ ID NO: 145106 - DNA, 865 bp, Homo sapiens
  Payload ID: 8669
  Gene Symbol: KATNAL2
  Gene Name: katanin p60 subunit A-like 2
  ENST ID: ENST00000585469
  CDS Start-End: 200-865
aggttccttggatcgaccggtcagcccagtaactgactacttttctcccttctctagggtcctagcacagtgtctgatggagctttcctaccagaccctgaaattcacgcatcaggcgcgggaagcgggtttattgccgtaggagcagtgttattttttgttgtcatcctacctaaattttcctctgttccagtgcgagatgaggacagaagcacgacgaaaaaatcttctcattttgatttcgcattatttaacacaagaagggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccgg

SEQ ID NO: 145107 - DNA, 994 bp, Homo sapiens
  Payload ID: 8669
  Gene Symbol: KATNAL2
  Gene Name: katanin p60 subunit A-like 2
  ENST ID: ENST00000591522
  CDS Start-End: 1-465
gaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgcttgaaagccattgcactccagcctggcgacagagcaagactccgtctcaaaaaaaaaaaaagtgtactagtccattttcatgctgctggtgaagacatatccaagactgggaagaaaaaaaaattaactggacttacagtttcacatggatggggagcctcagaatcatggcggggggcaaaagacacttcttatatggtggcagcaagagaaaatgaggaagacgcaagaagcggaaacccctgataaaaccatcagaccttgtgagacttattcactaccatgagaacagcatgcgtggtggaaactgctcacgattcaaattatctcctactgggtccctcccacaacacgtgggaattatgcgattacaattcaagatgagatttgggtggggacacagagccaaaccatatcaagaagtttaaggaaatggcctatggatgcaaaatcacataaacttggcctgacagttttgggaggagtaaaagtgagtgtctgaaagggcggttatttgcactgggcacccaggaagggccactggtgctaagttcaccaatgtaatgaagtgaggggtcattcactccagaaggactgagaattttggaagaattaatgtacttagagtgcccaacttattgtcagcaataatttactcactggcaagatcggactgaataattcatgttacaactgcaatcagaatactcatgattgctggttgttagttggtttttgtaccccaaattaagtcgcataaaattacttccttttc

SEQ ID NO: 145108 - DNA, 1348 bp, Homo sapiens
  Payload ID: 8669
  Gene Symbol: KATNAL2
  Gene Name: katanin p60 subunit A-like 2
  ENST ID: ENST00000592005
  CDS Start-End: 674-991
gccgggcccgtcacgtgaacggcgcgggagctccgcctccgacgcgccgaagccccgcccctagcggtgccccctgcccacccgcgcgaccgccttccgcccgcgccttcagtccgcgcggcgacagcgcccgcccgcgcctgccccggcgtgctgccccgcggcttggccccgctcggccccaggtcgtgccttccctccccggcggaggcccctgcggactgcctagagctgggtcgcaactgaggcgttatccgcgggcctggcctcgggaagtggcggggaggaagaagaggcggccgggacgcgtgacaggagcattcgggaagattcttacggtgcccttcacgcggtgcctatggacggagaaagccgccgcaaataaaaccatcccccagagtagttgtggcggaataatctaaatatgggtgttggattgaggaaacttgaatatttttgtatcctgaagggagaaatggatgaagaagaaatggatgaagaagaccgaagataatgatgaagggataatttggaataggattcacagcaagagagacagaagggaaagacattgaagaaacagactagttaacacatgaaaaaaatagagcagaggaaaacacgtccatgtttttccacgtctaatgagaacagggtcctagcacagtgtctgatggagctttcctaccagaccctgaaattcacgcatcaggcgcgggaagcggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgtaaccacatgcatttttgggctccaggaagaagctgtcctccctgcctgcaatcaaggtcttgattgtgccttcactagatcaacatttttccaaaagcagtctgccacagcttgaaagccattgcactccagcctggcgacagagcaagactccgtctcaaaaaaaaaaaaagtgtactagtccattttcatgctgctggtgaagacatatccaagactgggaagaaaaaaaaattaactggacttacagtttcacatggatggggagcctcagaatcatggcggggggcaaaagacacttcttatatggtggcagcaagagaaaatgaggaagacgcaagaagcggaaacccctgataaaaccatcagaccttgtgagacttattcactaccatgagaacagcatgcgtggtggaaact

SEQ ID NO: 145109 - DNA, 2664 bp, Homo sapiens
  Payload ID: 8670
  Gene Symbol: KATNB1
  Gene Name: katanin p80 (WD repeat containing) subunit B 1
  Uniprot ID: Q9BVA0
  ENST ID: ENST00000379661
  CDS Start-End: 393-2360
gggctctgagccggaggttttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattcccagg

SEQ ID NO: 145110 - DNA, 728 bp, Homo sapiens
  Payload ID: 8670
  Gene Symbol: KATNB1
  Gene Name: katanin p80 (WD repeat containing) subunit B 1
  ENST ID: ENST00000566726
  CDS Start-End: 104-728
ggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtggaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctgg

SEQ ID NO: 145111 - DNA, 853 bp, Homo sapiens
  Payload ID: 8670
  Gene Symbol: KATNB1
  Gene Name: katanin p80 (WD repeat containing) subunit B 1
  ENST ID: ENST00000562592
  CDS Start-End: 222-853
gccggaggttttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacag

SEQ ID NO: 145112 - DNA, 622 bp, Homo sapiens
  Payload ID: 8670
  Gene Symbol: KATNB1
  Gene Name: katanin p80 (WD repeat containing) subunit B 1
  ENST ID: ENST00000569627
  CDS Start-End: 272-622
tgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaactctgggacatcaggaggaaaggctgtgtcttccgatacagggggcacagccaggccgtgcg

SEQ ID NO: 145113 - DNA, 827 bp, Homo sapiens
  Payload ID: 8670
  Gene Symbol: KATNB1
  Gene Name: katanin p80 (WD repeat containing) subunit B 1
  ENST ID: ENST00000563462
  CDS Start-End: 1-827
cccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagggccacactgtcccccactgccccacccctgacggtgctctgtttgcacagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtc

SEQ ID NO: 145114 - DNA, 619 bp, Homo sapiens
  Payload ID: 8670
  Gene Symbol: KATNB1
  Gene Name: katanin p80 (WD repeat containing) subunit B 1
  ENST ID: ENST00000566785
  CDS Start-End: 383-619
ctggcctctgggaggagtttctttttccttacgttccaaatcaccctacctgaggtgccccctctgcagattcccaaacctaatttgcagtgcagcttctgactctggtggctttgccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtg

SEQ ID NO: 145115 - DNA, 2723 bp, Homo sapiens
  Payload ID: 8671
  Gene Symbol: KATNBL1
  Gene Name: katanin p80 subunit B-like 1
  Uniprot ID: Q9H079
  ENST ID: ENST00000256544
  CDS Start-End: 144-1058
gcgcgcgcggccgcgtttgaatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgctta

SEQ ID NO: 145116 - DNA, 797 bp, Homo sapiens
  Payload ID: 8671
  Gene Symbol: KATNBL1
  Gene Name: katanin p80 subunit B-like 1
  ENST ID: ENST00000557877
  CDS Start-End: 262-797
gccgggcgctggtcgtcagcgccgaggctgggctgaggcgccgcggtaccatgaggcgccgctcgccctctgtaggctgcatccactgtccagccagtcccagtgagatgaaccaggtacctcagttggaaatgcagaaatcacccgtcttctgtgttgatcaccctgggagctgcagaccggagctgttcctattataatggccatcttggaatggacttgccatctctacttcttgatgtccttggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtga

SEQ ID NO: 145117 - DNA, 884 bp, Homo sapiens
  Payload ID: 8671
  Gene Symbol: KATNBL1
  Gene Name: katanin p80 subunit B-like 1
  ENST ID: ENST00000561270
  CDS Start-End: 1-507
aaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgagaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaac

SEQ ID NO: 145118 - DNA, 572 bp, Homo sapiens
  Payload ID: 8671
  Gene Symbol: KATNBL1
  Gene Name: katanin p80 subunit B-like 1
  ENST ID: ENST00000559464
  CDS Start-End: 456-572
tgttctttccgtcttcacaataaatcttgctgttgctcactgtttgggtccgcatcacctttaagagctggaacacttgccacgaaggtcctccggcttcattcttgaattcggccagactacgaacccaccggaaggaagaaactccggacacatcggaaggaacaaactctggaccacgaacccaccagagggaagaaactctggacacaccatttttgagagctgtaacagcgtgaaggtccacgacttcattcttgagtggttataaactgttttcaccttcaagattcttgagagataactacacataccctttgccatagtgggaatgactgtgtagtagtaactggaggagaaagtttctttgtacacaactatgctttgattttcaagaggaggaatgaaattgcctcgtaaaattacagagttaaatacaatgtacttaagagattatggcatcagaaacccacaatgttaaaaaacggaacttttgtaataagattgaggatcatttcattgatcttcctagaaaaaagatctctaatttcactaataagaacatgaaggag

SEQ ID NO: 145119 - DNA, 555 bp, Homo sapiens
  Payload ID: 8671
  Gene Symbol: KATNBL1
  Gene Name: katanin p80 subunit B-like 1
  ENST ID: ENST00000561371
  CDS Start-End: 1-334
aagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaagaaattgaaagaagagggccgggcaaggtggctcatgcctgtaatcccagtactttgggaggccaaggtgggcagatcacgagctcaggagatcgagaccatcccggccaacatggtgaaaccccatctctactaaaacacaaaaaattagccgggcgtggtggtgcacacctgtagtcccagctacttgggaggctgaggctggagaatcacttgaaccctggaggtggaggttgcagagagccaagatcacgccactgcacttcagcctggtgacagagcaagactctgtctcaaaaaaaagagaaagaaattgaaagaggctattgtcaagctgggctcaagtgaatatagcac

SEQ ID NO: 145120 - DNA, 733 bp, Homo sapiens
  Payload ID: 8671
  Gene Symbol: KATNBL1
  Gene Name: katanin p80 subunit B-like 1
  ENST ID: ENST00000559760
  CDS Start-End: 1-459
gtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggtcctctgcgtgtaactgtgaccttggcagcaagcacaggaattggccattgaacatgtttcatgtacagcccctgaaatgctatgctagaggatatttacagagggttttaatcagagaaaagtatttgaaaaaattttgagaatccaataaggacagcatcagaaaacaagacgaggaactcaggaaacaagggataagaaacataattaaatggttttggagattaagttttacttttgctaatgttatgctttttgagaaggtaaactatttaaatcacagtgaa

SEQ ID NO: 145121 - DNA, 436 bp, Homo sapiens
  Payload ID: 8671
  Gene Symbol: KATNBL1
  Gene Name: katanin p80 subunit B-like 1
  ENST ID: ENST00000559515
  CDS Start-End: 214-436
gcgcgcggccgcgtttgaatggccctgagtgggactcggcccagaagccgagggactctctaggctgccgggcgctggtcgtcagcgccgaggctgggctgaggcgccgcggtaccatgaggcgccgaaactatgggatgatggtgagaatttcacagcaggaaagattgggaagtttaaggatctgaacaggagttaggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaag

SEQ ID NO: 145122 - DNA, 853 bp, Homo sapiens
  Payload ID: 8671
  Gene Symbol: KATNBL1
  Gene Name: katanin p80 subunit B-like 1
  ENST ID: ENST00000560108
  CDS Start-End: 323-853
gcgcgcgcggccgcgtttgaatggccctgagtgggactcggcccagaagccgagggactctctaggctgccgggcgctggtcgtcagcgccgaggctgggctgaggcgccgcggtaccatgaggcgccgtggttataaactgttttcaccttcaagattcttgagagataactacacataccctttgccatagtgggaatgactgtgtagtagtaactggaggagaaagtttctttgtacacaactatgctttgattttcaagaggaggaatgaaattgcctcgtaaaattacagagttaaatacaatgtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtata

SEQ ID NO: 145123 - DNA, 562 bp, Homo sapiens
  Payload ID: 8671
  Gene Symbol: KATNBL1
  Gene Name: katanin p80 subunit B-like 1
  ENST ID: ENST00000559462
  CDS Start-End: 318-562
agctatcccggcgggccgcgcgcgcggccgcgtttgaatggccctgagtgggactcggcccagaagccgagggactctctaggctgccgggcgctggtcgtcagcgccgaggctgggctgaggcgccgcggtaccatgaggcgccggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataag

SEQ ID NO: 145124 - DNA, 597 bp, Homo sapiens
  Payload ID: 8671
  Gene Symbol: KATNBL1
  Gene Name: katanin p80 subunit B-like 1
  ENST ID: ENST00000560310
  CDS Start-End: 218-597
atgctcttgcgaccactccaggcacgattggcacccttctgcagaagttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagt

SEQ ID NO: 145125 - DNA, 1913 bp, Homo sapiens
  Payload ID: 8672
  Gene Symbol: KAZALD1
  Gene Name: Kazal-type serine peptidase inhibitor domain 1
  Uniprot ID: Q96I82
  ENST ID: ENST00000370200
  CDS Start-End: 327-1241
ggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggtgggtgagcggctatagtgttcatccctgctcttgaaaagacctggaaaggggagcagggtcccttcatcgactgctttcatgctgtcagtagggatgatcatgggaggcctatttgactccaaggtagcagtgtggtaggatagagacaaaagctggaggagggtagggagagaagctgagaccaggaccggtggggtacaaaggggcccatgcaggagatgccctggccagtaggacctccaacaggttgtttcccaggctggggtgggggcctgagcagacacagaggtgcaggcaccaggattctccacttcttccagccctgctgggccacagttctaactgcccttcctcccaggccctggttcttgctatttcctggtccccaacgtttatctagcttgtttgccctttccccaaactcatcttccagaacttttccctctctcctaagccccagttgcacctactaactgcagtcccttttgctgtctgccgtcttttgtacaagagagagaacagcggagcatgacttagttcagtgcagagagataggtgaggccagctcgagatcttataccactctgtattggacaaaggctagcacagggctaggcaccaataaagatttctaatgatgcacaga

SEQ ID NO: 145126 - DNA, 3838 bp, Homo sapiens
  Payload ID: 8673
  Gene Symbol: KAZN
  Gene Name: kazrin, periplakin interacting protein
  Uniprot ID: Q674X7
  ENST ID: ENST00000361144
  CDS Start-End: 236-1483
agccgttcccacgtgagaggctccgcggccgaattcctcgcgtgcagcaggcgcggaccgcccggcgtccggccggactgagagccctggtccggcgcgcgccgccggccgggcgggaggcgggggcgggctcggctgcgccccgatgcggcggcgacctccgggtctgtgagcccggcgcgcgccgtcggagcccctcgcgcagccgctggtagcgtccccccgggcacccggcatgcgggcggccgactcgggctcgtgggagcgcgtccgccagctcgcggcgcagggcgagccggcgccttcctgcggggcgggggccgggcccgcgcggcccccgggacccgcagcctgcgagcagtgcgtggacgcggcggggcccggcgatcggccccgcgccggggttccccgggtccgagcggatggcgactgcagccagcccgtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatga

SEQ ID NO: 145127 - DNA, 800 bp, Homo sapiens
  Payload ID: 8673
  Gene Symbol: KAZN
  Gene Name: kazrin, periplakin interacting protein
  ENST ID: ENST00000376028
  CDS Start-End: 302-800
gggagagggaaggtcaggcttgcctcctgttcacaaggacaacctctgtctcccttgtggcggcttctatgaaggtggggactccaggctttctctcgtctgctttttggatgccttcaagagaggccagttagaggatatcaattgtggcaattccccagagccctcatcagatggcattagcccgtcatgtgctgcagtggcacccagtttggaggaaattcggaaccagaagagtgtgacagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcg

SEQ ID NO: 145128 - DNA, 6030 bp, Homo sapiens
  Payload ID: 8673
  Gene Symbol: KAZN
  Gene Name: kazrin, periplakin interacting protein
  Uniprot ID: Q674X7
  ENST ID: ENST00000376030
  CDS Start-End: 295-2622
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatgactcggacagccagtgcagccccacgcggcagagcctcagcctgtcggaaggcgaggagcagatggaccggctgcagcaggtggagctggtgaggaccacccctatgtcccactggaaggcgggcaccgtccaggcctggctggaggtggtgatggccatgcctatgtacgtcaaggcctgcacggagaacgtgaagagcgggaaggtgctgctgagcctgagtgacgaggacctgcagctgggccttggggtgtgcagctccctgcaccggcgcaagctgcgcctggccatcgaggactaccgtgatgccgaggcaggccgcagcctgtccaaagctgccgagctggaccatcactgggtggccaaggcctggctgaatgacattggcctgtcccagtactcccaggcctttcagaaccacctggttgatgggcggatgctgaattccctgatgaagcgagacctggagaagcacctgaacgtgtccaagaagttccaccaggtcagcatcctgctggggatcgagctgctgtaccaagtgaacttcagcagggaggccctccaggagcgccgggcccgctgcgagacgcagaacattgaccccgtggtgtggaccaaccagcgggtgctcaagtgggttcgagacatcgacctgaaggagtacgcagacaacctgaccaacagcggcgtccatggtgctgtgctggtgctggagcccacattcaatgccgaggccatggccactgccctgggcatccccagtgggaagcacatcctccggagacacctggcagaggagatgagcgccgtcttccacccagccaactccacaggcatccgggaggctgagcgttttggaacgccccctggcagggcctccagcgtcacgcgggcaggaaaggaggagaacagcagcggtctcaagtacaaggctggccggctgcccctggggaagataggaaggggcttcagcagcaaagatcccgatttccatgatgactatggctctcttcaaaacgaagattgcggagacgatgacccccagagcaggctggaacagtgccgtctggaaggctacaacagcctggaggtcaccaacgtgtaaggaactggtggctccaccagacccaacgtgagagacccaggaaggaagagaagccagatggccccaggtgtcgttctcactgtacatagcggccgcaggctgaggatgtcccttgctcctgggcaaaatcccgatggactctgcggtttcagctccacagcgcccaggagagagaagacaccagcccacctgtcttgggtgggccatggactttcctgttcagctggagatgggcccagaggacctgtcacagtgtccggccctgcctccatccaggatacacaggctccacctcagagtgaccgtcactgtggagcagccaagcagtccctggagccttaaacggagctgccaaggtgggaggaggcccacagttccctaaaacacccttccggcgggagcaggggggaccccaaccccacaccccagcgcccagtgcattggcagagccgggtgcaggaagtgctgcctcttgccgagacgtcggacagggcgggggttggggaactctcggctacagcatcttacccttgactgagaacttgggtcctgacttggctcactgaatctctcttgggagaatgcaaaatccttccacctgaaaagctctgtgacacatgggggtggacgtattgaagagctgtttgccgatccacccaggagtggctacgctgagtggggagccggtgaatgatccgtgcaggagtggggcttagcagccacatttctaggagatgcagatatcctatcaccagaatgaaagctattgggacaacaggatcggggatgaccgacggccccatatggtgaatctctggcctgtggtttggctttactgagattccaaaccccactatctgcactccgtgacagtggtatggagtgtggcaatgagtttggggtctggggcagggaaatgcttgacattgttaacccaacaaacctttgttgtgatgtccctgtcacctgaaacataggtgacatagctcaccaatgtcctaaccgagacacaaactccacagagcaaaatcatttggtattggtggggagaaccccagcccttttcttgacctgccactgttatgctgtgtggcttcttcccagtggcctcacctctctgtgcctcgatgtcttcatctacgatacttctggttccctcccagggacatcgtgaggattaacacttgctaatatctgtaacacaatttgtaacctctcaggagacaatgggaagttatggggtagctaatttcccatttacaacacagaaatgatatagagctagttcgctccaactctttaggttgaagcagtgtgcaaaaggaagaaaagaaatgtttaatgttcagacctgccaagagcctccaacagggctcaagaaacatataaatcccatgagcacagccttgaaaaccagtttgactcaagccttcgggcctcagttcattgaccagatgacagccacgtgatgattagggaaggacggatgcattgcgattctgcttacacatcgggttatcaaagcgagtcacttgttggaaccatgatgctcgacctccttcaaggccgtttgcactggggcttgagtttccaagattcacaacaggtgtcagcctctgagaaccctcaaagcgtgtgttcttcaacctggcaaattgtttcctctcatgggggaagccgagctctgatgaacttgagaattacacctctctcatgccgaagaccgtggtgttccccctaatgacataaacgcagcctttcttgctgtctgagaccaaatgtctagttggtagacaggtggatgtttggcctcctaagggcacacttctgatcctgggccccaggtggtgaatctctggcatgtggcttggctttgttgagactccaaattccattatcttcatgacattcggcctcatccatagggtcctgaagctgcagtccacagctcagaaaggagaggtgagacctccctccaacctggtgccacaggtctctcccaagccacatccagcctggatgacctgggaccccagaaactgccgtttgggaggcagcaacagcaacgtgcccaggcaggcagttattcccacagagtgagccagaattgtagcagggcacttgaatgcagagctgatgatttgaaaccaacgttcacccaacttgtcagaaatggcacttacatggttcgatcttgctggagacaagtggacaattgggggtcactggcagagacagtattgcccaaaatgttcacagcaggaggccagcaggcctgaggcaacacgggcaaccgcgaatgcctcttttggtttaaattatgccatcacaaccctctttcacccatgaggctccccatccctgacagccaggtgagcatttggagctggtttctcaacatgaggatgggttggttgttaaattaacaacctccacagtatcagattgagtgagctttgtctgctggaaaaacctgaaacgtcaactctgcttcaaggtcggcaagaagaacagaaggcggagacttggcagagagactcaagctgattgtcacaggctacagaggggccagctccagaacagtgaccagctacatcctgtccaagcagcccgagtgtggtcttggtccctgcagggcaatgtgggcatctggacctggggacgatgtggatgcacttcttggaaagctgttgtagcttgtgcctgtgggtggagaaggcacctgcctggtagactctcagctttctgacccccaggagcctctgcgaggcccctttgtccttggctgagccggacctttcttttggaaatctgtctgtctgttggcatcgctgttttcagaccccaggctgcagaggaggggagaagccacacaacaatctggacccaataaagtggagagaagggcgtctctacacagcccggccagcgtggagggccccaggacagggacccaaaagcttgacgtcactgaacagggctgggtactggcagaacaggaagatttggccagaggtgacctcagtgttccctccaggggcatccaggcccctctgacctggggagaagaaggcccatgctcaggcccacctccctcttcccatcagagcccatgcgtcctgggcaccaccacttccactctgcttttcgaggctccggagggctcttcctgctgtgaaaggaaaggagaagaaagcctgtgggcaatggcaacctctgagtctggcattcttgccaatggctggccagcgaggagaatctcccgagccctgacacacaaaggcattttgtggctgcagaggaaatgggttggctctgaacaaagatgcagtttctagggccgtggccccaaatcgcttccccgagagtgaattttaacactgtaacaataaatactactgcacagca

SEQ ID NO: 145129 - DNA, 1295 bp, Homo sapiens
  Payload ID: 8673
  Gene Symbol: KAZN
  Gene Name: kazrin, periplakin interacting protein
  Uniprot ID: Q674X7
  ENST ID: ENST00000400797
  CDS Start-End: 312-1295
gcatcagcagctgtctgccagtgttgacggagggctcatgggtgccaggccgcttgctggggctttttatctgtcctcaggcattggcacagcagccctgggagatgaatactattgtgatcttcattctccacacaaggacagggaagtgacgtgccagggtcaaacaactacccaaggacagagccaggatttgaaccaggccatccagttccagaaccactgctcttcactgtcattgtggccattttacagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtga

SEQ ID NO: 145130 - DNA, 3643 bp, Homo sapiens
  Payload ID: 8673
  Gene Symbol: KAZN
  Gene Name: kazrin, periplakin interacting protein
  Uniprot ID: Q674X7
  ENST ID: ENST00000400798
  CDS Start-End: 302-1285
gggagagggaaggtcaggcttgcctcctgttcacaaggacaacctctgtctcccttgtggcggcttctatgaaggtggggactccaggctttctctcgtctgctttttggatgccttcaagagaggccagttagaggatatcaattgtggcaattccccagagccctcatcagatggcattagcccgtcatgtgctgcagtggcacccagtttggaggaaattcggaaccagaagagtgtgacagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctatatggggggtggcgttggccccaaagaggcttcaccagcaaaggaactgtgtgtattttaatgccaggggacggaggatgtgtgagctgttcagcaaggtctgcccaaggcctaaaactcaatttccttattcttttgcttctgctcgtccttaacaactaacagctcaacccacacctctagacaacagtagtcgtgctttctgctaacggtgacattttcagctcttaaaaagaagcaaggagattttcaaatgctagagtatctctatcagaaggcataggacattgtgtccaaagtctcaagaacaaacaacactttccttctgacctggtccaaaagtcagcaaacagcaagcaggcagaggccctcataaggacttttctgtcctcctttgaccaaactgtttaaccgagcctaggggtgacggggagcgacccaagctggcatctttctctacggagacagattttagaaaatacttttcttgcccatgaatttcttttctggttgatttttatcattttccctttacttacaagaaaataagattgcaaccactcctgctaatgatttagtagttccttttcatttcagtttttgtaaattaggagataattctaagagttactaaaggatgatttatttaagagaactacgtcaaatagcgaatgagttatgggtaacattagacgaaaataacctttcccgtgggaaaggtttctcgaaggcatggatgcaaatataaaatattaaaaaaaatctaaataaagcttattttaaaatatgatcg

SEQ ID NO: 145131 - DNA, 1475 bp, Homo sapiens
  Payload ID: 8673
  Gene Symbol: KAZN
  Gene Name: kazrin, periplakin interacting protein
  Uniprot ID: Q674X7
  ENST ID: ENST00000503743
  CDS Start-End: 210-1475
ggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtga

SEQ ID NO: 145132 - DNA, 3154 bp, Homo sapiens
  Payload ID: 8674
  Gene Symbol:
  Gene Name: KCNE1B
  ENST ID: ENST00000618699
  CDS Start-End: 201-599
gggctgtctgtggcctcagcgctcggcaggcgcgcactcagctccacacccggctctctcggcatctcagacccggtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcggtgacggcaagctggaggccctctacgtcctcatggtactgggattcttcggcttcttcaccctgggcatcatgctgagctacatccgctccaagaagctggagcactcgaacgacccattcaacgtctacatcgagtccaatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtggggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaatggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggagggcaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggaggggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcacggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctgtgcattcattagctaggacaacaatgcatttgcagtagtgagatttcgttaaaaaattaaagccatttactatg

SEQ ID NO: 145133 - DNA, 3149 bp, Homo sapiens
  Payload ID: 8674
  Gene Symbol:
  Gene Name: KCNE1B
  ENST ID: ENST00000622690
  CDS Start-End: 202-591
agtggcttcccccctggcaacctcaaactcccgcaggaaggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcggtgacggcaagctggaggccctctacgtcctcatggtactgggattcttcggcttcttcaccctgggcatcatgctgagctacatccgctccaagaagctggagcactcgaacgacccattcaacgtctacatcgagtccaatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtggggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaatggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggagggcaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggaggggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcacggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctgtgcattcattagctaggacaacaatgcatttgcagtagtgagatttcgttaaaaaattaaagccatttactatgatc

SEQ ID NO: 145134 - DNA, 736 bp, Homo sapiens
  Payload ID: 8674
  Gene Symbol:
  Gene Name: KCNE1B
  ENST ID: ENST00000617668
  CDS Start-End: 466-736
ctcttctcccctgggttcagctgggggccttacggaactccagggtgctggaggccccgttggtctccatttgcaggtgtctcgctcagcgcagctgcccagagccctgtgtcctgagtgatttccagtagattagcagctctgggtctaagcttttaagaaaaaaaaaaaattgcactacccttcagtaggggcagcattcacatctcacacccaggcagaagcagaaacggccaggaatccaccccactttctgggcctgacaaggccacagtttgagaacgttcagcacaggccaagcatcagatggattttgaacatctctggctcctaccatttctgcctccaccatccctttactcactgtgcaagctacaaaagctgaggggacaggaacaaggatgatttctgatggcatatttagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcggtgacggcaagctggaggccctctacgtcctcatggtactgggattcttcggcttcttcaccctgggcatcatgctgagctacatccgctccaagaagctggagcactcgaacgacccattcaacgtctacatcgagtccaatgcctggc

SEQ ID NO: 145135 - DNA, 811 bp, Homo sapiens
  Payload ID: 8674
  Gene Symbol:
  Gene Name: KCNE1B
  ENST ID: ENST00000623803
  CDS Start-End: 224-622
gtctgtggcctcagcgctcggcaggcgcgcactcagctccacacccggctctctcggcatctcagacccgggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcggtgacggcaagctggaggccctctacgtcctcatggtactgggattcttcggcttcttcaccctgggcatcatgctgagctacatccgctccaagaagctggagcactcgaacgacccattcaacgtctacatcgagtccaatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtggggggtggattaatgacactgtttcactgtttctctaaaatcacgttcttttgtgatagactgtca

SEQ ID NO: 145136 - DNA, 2060 bp, Homo sapiens
  Payload ID: 8675
  Gene Symbol: KDELC1
  Gene Name: KDEL (Lys-Asp-Glu-Leu) containing 1
  Uniprot ID: Q6UW63
  ENST ID: ENST00000376004
  CDS Start-End: 338-1846
cttggctggaacctgagacggattcgctcccaaatgatgctccagtggcaggagcaactcaagttcatcattgtcctgagagagaggagcagcgcggttctcggccgggacagcagaacgccaggggaccctcacctgggcgcgccggggcacgggctttgattgtcctggggtcgcggagacccgcgcgcctgccctgcacgccgggcggcaacctttgcagtcgcgttggctgctgcgatcggccggcgggtccctgccgaaggctcggctgcttctgtccacctcttacacttcttcatttatcggtggatcatttcgagagtccgtcttgtaaatgtttggcactttgctactttattgcttctttctggcgacagttccagcactcgccgagaccggcggagaaaggcagctgagcccggagaagagcgaaatatggggacccgggctaaaagcagacgtcgtccttcccgcccgctatttctatattcaggcagtggatacatcagggaataaattcacatcttctccaggcgaaaaggtcttccaggtgaaagtctcagcaccagaggagcaattcactagagttggagtccaggttttagaccgaaaagatgggtccttcatagtaagatacagaatgtatgcaagctacaaaaatctgaaggtggaaattaaattccaagggcaacatgtggccaaatccccatatattttaaaagggccggtttaccatgagaactgtgactgtcctctgcaagatagtgcagcctggctacgggagatgaactgccctgaaaccattgctcagattcagagagatctggcacatttccctgctgtggatccagaaaagattgcagtagaaatcccaaaaagatttggacagaggcagagcctatgtcactacaccttaaaggataacaaggtttatatcaagactcatggtgaacatgtaggttttagaattttcatggatgccatactactttctttgactagaaaggtgaagatgccagatgtggagctctttgttaatttgggagactggcctttggaaaaaaagaaatccaattcaaacatccatccgatcttttcctggtgtggctccacagattccaaggatatcgtgatgcctacgtacgatttgactgattctgttctggaaaccatgggccgggtaagtctggatatgatgtccgtgcaagctaacacgggtcctccctgggaaagcaaaaattccactgccgtctggagagggcgagacagccgcaaagagagactcgagctggttaaactcagtagaaaacacccagaactcatagacgctgctttcaccaactttttcttctttaaacacgatgaaaacctgtatggtcccattgtgaaacatatttcattttttgatttcttcaagcataagtatcaaataaatatcgatggcactgtagcagcttatcgcctgccatatttgctagttggtgacagtgttgtgctgaagcaggattccatctactatgaacatttttacaatgagctgcagccctggaaacactacattccagttaagagcaacctgagcgatctgctagaaaaacttaaatgggcgaaagatcacgatgaagaggccaaaaagatagcaaaagcaggacaagaatttgcaagaaataatctcatgggcgatgacatattctgttattatttcaaacttttccaggaatatgccaatttacaagtgagtgagccccaaatccgagagggcatgaaaagggtagaaccacagactgaggacgacctcttcccttgtacttgccataggaaaaagaccaaagatgaactctgatatgcaaaataacttctattagaataatggtgctctgaagactcttcttaactaaaaagaagaatttttttaagtattaattccatggacaatataaaatctgtgtgattgtttgcagtatgaagacacatttctacttatgcagtattctcatgactgtactttaaagtacatttttagaattttataataaaaccacctttattttaaagga

SEQ ID NO: 145137 - DNA, 4312 bp, Homo sapiens
  Payload ID: 8676
  Gene Symbol: KDELC2
  Gene Name: KDEL (Lys-Asp-Glu-Leu) containing 2
  Uniprot ID: Q7Z4H8
  ENST ID: ENST00000323468
  CDS Start-End: 67-1590
ggtccgcggcgctgccggcccctcctcgccgccgcggagctggaccgcagttgtgccccgccgaccatgcgccgcctcccgcgggccctgctgctgcagctgcgcctcgccctgctggtggccgcgggggccccggaggtgctggtcagcgcgccgcggagcctggtgtgggggcccgggctgcaggcggccgtcgtcctgccggtccgctatttctacctgcaggcggtcaactcggagggccagaacctcactcgctctcccgcaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaagttgaaaaaga

SEQ ID NO: 145138 - DNA, 4374 bp, Homo sapiens
  Payload ID: 8676
  Gene Symbol: KDELC2
  Gene Name: KDEL (Lys-Asp-Glu-Leu) containing 2
  Uniprot ID: Q7Z4H8
  ENST ID: ENST00000434945
  CDS Start-End: 304-1659
tatagtcccagctactcatggggctgatgcaggttgaggcaggaggttcatgagcccaggaggttggagctgtaatgagctaggattctgcctctgcactcctagctggatgacagagcaagaccctgtctcaaaaaagaaaaaaaaaaaaaaaagaatgcatgaaccagacatgacagttcctggcctcaaagatcttccaaaggaaatgatttttttttaaccaccaatgctgcaggaaaaagcaacatatttaagttatccaataacacctatccaataattgtaaatcattatcatgacatggtagagttgtttatatttcttttccttttaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaagttg

SEQ ID NO: 145139 - DNA, 3241 bp, Homo sapiens
  Payload ID: 8676
  Gene Symbol: KDELC2
  Gene Name: KDEL (Lys-Asp-Glu-Leu) containing 2
  Uniprot ID: Q7Z4H8
  ENST ID: ENST00000530529
  CDS Start-End: 17-1246
aaatcattatcatgacatggtagagttgtttatatttcttttccttttaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaagagtttcactctgtcgcccaggctggaatgcagtggcacgatctccactcactgcaacctctgcctcccgggttcaaggaatttcgtgcctcagcctcctgagtagctgggattacaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctc

SEQ ID NO: 145140 - DNA, 568 bp, Homo sapiens
  Payload ID: 8676
  Gene Symbol: KDELC2
  Gene Name: KDEL (Lys-Asp-Glu-Leu) containing 2
  ENST ID: ENST00000530318
  CDS Start-End: 1-481
tgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactg

SEQ ID NO: 145141 - DNA, 1557 bp, Homo sapiens
  Payload ID: 8677
  Gene Symbol: KDELR1
  Gene Name: KDEL (Lys-Asp-Glu-Leu) endoplasmic reticulum protein retention receptor 1
  Uniprot ID: P24390
  ENST ID: ENST00000330720
  CDS Start-End: 196-834
ctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaaccttt

SEQ ID NO: 145142 - DNA, 1594 bp, Homo sapiens
  Payload ID: 8677
  Gene Symbol: KDELR1
  Gene Name: KDEL (Lys-Asp-Glu-Leu) endoplasmic reticulum protein retention receptor 1
  Uniprot ID: P24390
  ENST ID: ENST00000597017
  CDS Start-End: 427-879
agactgcgggaggaccctgaggggccaggggtagccatgaggcctagtctgggacggagcctcgggctggagtagcttcgggggcctgggctgccccctggctgtggtccgtgggaaagggccctgctcaggcggggcgggctggggaggcctccggggacagctgcactccagagctgcctccaggctggtcccgggcgccctgccttagtttattgcccatgcagcccacccccagcttcctctctccttctgtctgtctgtctgtctgtctgtctctctctctctctctgtctctctctctctctctttctctgtctctggaccacaggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatg

SEQ ID NO: 145143 - DNA, 815 bp, Homo sapiens
  Payload ID: 8677
  Gene Symbol: KDELR1
  Gene Name: KDEL (Lys-Asp-Glu-Leu) endoplasmic reticulum protein retention receptor 1
  ENST ID: ENST00000600980
  CDS Start-End: 154-815
ccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggaggaagataggcctgggtggccagatgtgctgatcttttcaacagaagccataattcaggagttttcagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctata

SEQ ID NO: 145144 - DNA, 2884 bp, Homo sapiens
  Payload ID: 8678
  Gene Symbol: KDELR2
  Gene Name: KDEL (Lys-Asp-Glu-Leu) endoplasmic reticulum protein retention receptor 2
  Uniprot ID: P33947
  ENST ID: ENST00000258739
  CDS Start-End: 186-824
ggcggggcctggccccgctctcccagggtgccccgcgcgcgcgcgcgccggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctatttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttaattacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatattttta

SEQ ID NO: 145145 - DNA, 583 bp, Homo sapiens
  Payload ID: 8678
  Gene Symbol: KDELR2
  Gene Name: KDEL (Lys-Asp-Glu-Leu) endoplasmic reticulum protein retention receptor 2
  ENST ID: ENST00000382267
  CDS Start-End: 93-209
atcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggcctcgcctgtctccttggaacataactgagatccgggaagtaagcaaaaccaaaaagacctttgaacagttaagatgggtgttacaaagtccatgtgccagtgtgtttgacttggaggttatctctcagttgatacatagttctgagaggttcaactgtatgatttccagtgacagcaaataactgctgcagtttgggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttct

SEQ ID NO: 145146 - DNA, 655 bp, Homo sapiens
  Payload ID: 8678
  Gene Symbol: KDELR2
  Gene Name: KDEL (Lys-Asp-Glu-Leu) endoplasmic reticulum protein retention receptor 2
  Uniprot ID: P33947
  ENST ID: ENST00000490996
  CDS Start-End: 1-561
atgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttc

SEQ ID NO: 145147 - DNA, 1728 bp, Homo sapiens
  Payload ID: 8679
  Gene Symbol: KDELR3
  Gene Name: KDEL (Lys-Asp-Glu-Leu) endoplasmic reticulum protein retention receptor 3
  Uniprot ID: O43731
  ENST ID: ENST00000216014
  CDS Start-End: 173-817
ccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacaccttattgtcaa

SEQ ID NO: 145148 - DNA, 931 bp, Homo sapiens
  Payload ID: 8679
  Gene Symbol: KDELR3
  Gene Name: KDEL (Lys-Asp-Glu-Leu) endoplasmic reticulum protein retention receptor 3
  Uniprot ID: O43731
  ENST ID: ENST00000409006
  CDS Start-End: 157-819
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaaaa

SEQ ID NO: 145149 - DNA, 2691 bp, Homo sapiens
  Payload ID: 8680
  Gene Symbol: KLHDC1
  Gene Name: kelch domain containing 1
  Uniprot ID: Q8N7A1
  ENST ID: ENST00000359332
  CDS Start-End: 91-1311
gttcgtgcgtggagcagtcggggctggaggcgaggccgccgggcgggcaggggttgtggcgcggcaagcggcgggccagcgacggcgcgaatggcggactctcagctgttctgtgtggcggaggaacgcagcggccactgcgccgtggtggacggaaacttcctctacgtgtgggggggctacgtgtctattgaagacaatgaagtatatttgcctaatgatgaaatttggacctatgatattgatagtgggttgtggagaatgcacctcatggaaggagaactcccagcctccatgtcaggaagctgtggtgcttgcattaatggaaagctgtacatttttggaggatatgatgacaaaggatacagcaatcgactttattttgttaatttacgaacaagagatgaaacctacatttgggagaaaatcaccgactttgaagggcaaccacctacaccacgtgataaactttcctgctgggtatataaagacagactaatatattttggtggttatgggtgtaggagacacagtgaactccaagactgttttgatgttcatgatgcatcttgggaagagcagatattctggggatggcataatgatgtccacatatttgacacaaagacacagacttggtttcaaccagaaattaaaggtggagttccaccacagccacgagccgcgcatacatgtgcagttcttggaaataagggttatatctttggcggacgtgttctgcaaactaggatgaatgatttgcactatctaaacctagacacctggacttggtctggaaggattactattaatggagaaagcccaaaacatcggtcatggcatactttaacacctatagctgatgataaacttttcctatgtggtggactaagtgcagataatatcccattaagtgatggttggattcataatgtcacaacaaattgttggaaacaacttacacatttacctaaaacaagacctaggttatggcacacagcctgtttgggaaaagaaaatgaaataatggtatttggtgggagcaaagatgacttacttgccttggatacaggtcactgtaatgatttattgatctttcaaacacagccttattcactactcaggtcatgccttgactgcattggtaaaaattctatcatgttagaaagtcagatatctttattacctcctaaacttctgcaacaagtactcaaaaaaataacattttgggctgcagctaatcaccgagaagaacaaagagtccaaaaagaagaaacagaaaataaatatcagtggatcagtagcaattaaattgttatatactttacatatttagtatgttttaactttttaatcagactatacatttacactcccaaattgcaggctttatttaaaggataaaatttaaaggataaaaaaacagtcactctgttaagtgactatatgccatgggatatatggaaaaaagatattaatgcagattaatttatatttgtaaacaaatttccttacaaactgcagaacaaatattctttctgaaagtaagtacagttataacagattttaaatcaatgtgtattctttactggaaagattacatacatttgagaataagaaattactctcaagaacttcagaaatctgcaacataattttataaatatataaatacatgtatgtatgtcaaaacactacatatacactttcagaaagaataaactttctcaagtcattttaaagttacctaacgttcttcttgaataactaatacagtgggtcaaatattataaaataggcaaacaccaaaatggtattaaatattgaactcctgaccttttcgacacttacctagtaaagtattcttaggcatcatcataacttttcctcacctttattcgaatagaggaataaatgtcttcagttgtctctccattacccctaagttattagtttgtctagtttatatataaagaccatgttttaaagtacataaagtggaggtttatttatcatacaggctttgaaacattaagaagcagtatttttattaactttttgagacatattaaaatacattttgccttagaagactgcttctaaagtaatttttgtaagtaatgagatgggatggtaatctagtaatttgactttatagaaatccctcagtttggcccccaccattctacagagttgtactcaagacagatactgaaaaaatctaataccttcccttgtattttcagcattaccatctatacagaaatggaacactgtatctttatattcctaaaaatggtacttttggcataattaagaaatttttcttcatattatcacaatcatgcccttccattgaattattaattacaattaattactaaaaagcttggtatgtaaaattattctccacaatattaccatgcaagttatctctgaaatttaaaatgttaaagaaaaacatttctatattgaaatatatataatttataatgaaaattatagtagtttgtagtatttcattgaattttagagagatatttcatatatatgtactgtattttggatgtgtaaagcttctatgtattgaaatatttttttacgttttatttattgtacaaagtgtatataattactgttttcttttttgtcagtgtaaagcagtcattagaattgattatacaaaaaata

SEQ ID NO: 145150 - DNA, 1360 bp, Homo sapiens
  Payload ID: 8680
  Gene Symbol: KLHDC1
  Gene Name: kelch domain containing 1
  ENST ID: ENST00000556392
  CDS Start-End: 91-381
gttcgtgcgtggagcagtcggggctggaggcgaggccgccgggcgggcaggggttgtggcgcggcaagcggcgggccagcgacggcgcgaatggcggactctcagctgttctgtgtggcggaggaacgcagcggccactgcgccgtggtggacggaaacttcctctacgtgtgggggggctacgtgtctattgaagacaatgaagtatatttgcctaatgatgaaatttggacctatgatattgatagtgggttgtggagaatgcacctcatggaaggagaactcccagcctccatgtcaggaagctgtggtgcttgcattaatggaaagctgtacatttttggaggatatgatgacaaaggatacagcaatcgaagatgaaacctacatttgggagaaaatcaccgactttgaagggcaaccacctacaccacgtgataaactttcctgctgggtatataaagacagactaatatattttggtggttatgggtgtaggagacacagtgaactccaagactgttttgatgttcatgatgcatcttgggaagagcagatattctggggatggcataatgatgtccacatatttgacacaaagacacagacttggtttcaaccagaaattaaaggtggagttccaccacagccacgagccgcgcatacatgtgcagttcttggaaataagggttatatctttggcggacgtgttctgcaaactaggatgaatgatttgcactatctaaacctagacacctggacttggtctggaaggattactattaatggagaaagcccaaaacatcggtcatggcatactttaacacctatagctgatgataaacttttcctatgtggtggactaagtgcagataatatcccattaagtgatggttggattcataatgtcacaacaaattgttggaaacaacttacacatttacctaaaacaagacctaggttatggcacacagcctgtttgggaaaagaaaatgaaataatggtatttggtgggagcaaagatgacttacttgccttggatacaggtcactgtaatgatttattgatctttcaaacacagccttattcactactcaggtcatgccttgactgcattggtaaaaattctatcatgttagaaagtcagatatctttattacctcctaaacttctgcaacaagtactcaaaaaaataacattttgggctgcagctaatcaccgagaagaacaaagagtccaaaaagaagaaacagaaaataaatatcagtggatcagtagcaattaaattgttatatactttacatatttagtatgttttaactttttaatcagactatacatttacactcccaaattgcag

SEQ ID NO: 145151 - DNA, 655 bp, Homo sapiens
  Payload ID: 8680
  Gene Symbol: KLHDC1
  Gene Name: kelch domain containing 1
  ENST ID: ENST00000557128
  CDS Start-End: 67-655
tggaggcgaggccgccgggcgggcaggggttgtggcgcggcaagcggcgggccagcgacggcgcgaatggcggactctcagctgttctgtgtggcggaggaacgcagcggccactgcgccgtggtggacggaaacttcctctacgtgtgggggggctacgtggaagagcagatattctggggatggcataatgatgtccacatatttgacacaaagacacagacttggtttcaaccagaaattaaaggtggagttccaccacagccacgagccgcgcatacatgtgcagttcttggaaataagggttatatctttggcggacgtgttctgcaaactaggatgaatgatttgcactatctaaacctagacacctggacttggtctggaaggattactattaatggagaaagcccaaaacatcggtcatggcatactttaacacctatagctgatgataaacttttcctatgtggtggactaagtgcagataatatcccattaagtgatggttggattcataatgtcacaacaaattgttggaaacaacttacacatttacctaaaacaagacctaggttatggcacacagcctgtttgggaaaagaaaatgaaataatggtatttggtgggagcaaagatgacttacttgccttgg

SEQ ID NO: 145152 - DNA, 1447 bp, Homo sapiens
  Payload ID: 8680
  Gene Symbol: KLHDC1
  Gene Name: kelch domain containing 1
  ENST ID: ENST00000555704
  CDS Start-End: 91-294
gttcgtgcgtggagcagtcggggctggaggcgaggccgccgggcgggcaggggttgtggcgcggcaagcggcgggccagcgacggcgcgaatggcggactctcagctgttctgtgtggcggaggaacgcagcggccactgcgccgtggtggacggaaacttcctctacgtgtgggggggctacgtgatggagtctcgctcttgcccaggctggagtgcagtggcgcgatctcggctcactgcaacctccgcctcccaggttcaaccaattctcctgcctcagcctcccgagtagctgggactacaggtgcttcccaccatgcccagtctattgaagacaatgaagtatatttgcctaatgatgaaatttggacctatgatattgatagtgggttgtggagaatgcacctcatggaaggagaactcccagcctccatgtcaggaagctgtggtgcttgcattaatggaaagctgtacatttttggaggatatgatgacaaaggatacagcaatcgactttattttgttaatttacgaacaagagatgaaacctacatttgggagaaaatcaccgactttgaagggcaaccacctacaccacgtgataaactttcctgctgggtatataaagacagactaatatattttggtggttatgggtgtaggagacacagtgaactccaagactgttttgatgttcatgatgcatcttggggtggagttccaccacagccacgagccgcgcatacatgtgcagttcttggaaataagggttatatctttggcggacgtgttctgcaaactaggatgaatgatttgcactatctaaacctagacacctggacttggtctggaaggattactattaatggagaaagcccaaaacatcggtcatggcatactttaacacctatagctgatgataaacttttcctatgtggtggactaagtgcagataatatcccattaagtgatggttggattcataatgtcacaacaaattgttggaaacaacttacacatttacctaaaacaagacctaggttatggcacacagcctgtttgggaaaagaaaatgaaataatggtatttggtgggagcaaagatgacttacttgccttggatacaggtcactgtaatgatttattgatctttcaaacacagccttattcactactcaggtcatgccttgactgcattggtaaaaattctatcatgttagaaagtcagatatctttattacctcctaaacttctgcaacaagtactcaaaaaaataacattttgggctgcagctaatcaccgagaagaacaaagagtccaaaaagaagaaacagaaaataaatatcagtggatcagtagcaattaaattgttatatactttacatatttagtatgttttaactttttaatcagactatacatttacactcccaaattgcaggcttt

SEQ ID NO: 145153 - DNA, 645 bp, Homo sapiens
  Payload ID: 8680
  Gene Symbol: KLHDC1
  Gene Name: kelch domain containing 1
  ENST ID: ENST00000553274
  CDS Start-End: 76-645
agtcggggctggaggcgaggccgccgggcgggcaggggttgtggcgcggcaagcggcgggccagcgacggcgcgaatggcggactctcagctgttctgtgtggcggaggaacgcagcggccactgcgccgtggtggacggaaacttcctctacgtgtgggggggctacgtgtctattgaagacaatgaagtatatttgcctaatgatgaaatttggacctatgatattgatagtgggttgtggagaatgcacctcatggaaggagaactcccagcctccatgtcaggaagctgtggtgcttgcattaatggaaagctgtacatttttggaggatatgatgacaaaggatacagcaatcgactttattttgttaatttacgaacaagagatgaaacctacatttgggagaaaatcaccgactttgaagggcaaccacctacaccacgtgataaactttcctgctgggtatataaagacaggaagagcagatattctggggatggcataatgatgtccacatatttgacacaaagacacagacttggtttcaaccagaaattaaaggtggagttccaccacagccacgagccgcgcatacatgtgcagttcttggaaataagggttatatctttggcggacgtgttc

SEQ ID NO: 145154 - DNA, 6437 bp, Homo sapiens
  Payload ID: 8681
  Gene Symbol: KLHDC10
  Gene Name: kelch domain containing 10
  Uniprot ID: Q6PID8
  ENST ID: ENST00000335420
  CDS Start-End: 135-1463
tggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggtaagaagaaaatacgatgggacccagttaggaggcgcttcattcagtcctgtcccatcataaggatccctaacaggtttttgagaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaataggttgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaatttgaaaaaaaaaaaaaaaaaaaaacaactttttataagttttttaagggccctgcttagtcagtgtacagggtggagtcagaggcagttttcagaaaaaaacaaaaaacaatttcaccaagcggtagtaattgttgttttactagttatacatttagaatataaaggaggcatcagaaaacacactctctaaagccacttccttgtgcacagagtctgcacagggagagcacaggcatctccctggaaaagcacctgccaatgacgaatttcatggaagaacctaggcaagaaaggaagcctctttctgagacacagtctctgagaggtgagcctagctttgctcttcctacagggtatgcttgggccatacacaatgctcgccttactttaaagctattttgccacagtcctgttaaatagtgtggacgtccttttgcagtctggtgtgcatgccatatgatcaggacagcttttccactttactcggtttcctacaagcaagtaggaaatacagtgaatttaccctaaaatgtccaatctgtatttatgtaccttgtcagtgttttgctgttggttttctaaaacaatctgatcaataaatcttatccaaatcaatttggttcaagttca

SEQ ID NO: 145155 - DNA, 772 bp, Homo sapiens
  Payload ID: 8681
  Gene Symbol: KLHDC10
  Gene Name: kelch domain containing 10
  ENST ID: ENST00000468226
  CDS Start-End: 339-772
ccgcttcgtgcaactctccgggcggccgcacctgccaggaatagattcctagaagtggaatagctgggtcaaagggtaagaagaaaatacgatgggacccagttaggaggcgcttcattcagtcctgtcccatcataaggatccctaacaggtttttgagaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaa

SEQ ID NO: 145156 - DNA, 503 bp, Homo sapiens
  Payload ID: 8681
  Gene Symbol: KLHDC10
  Gene Name: kelch domain containing 10
  ENST ID: ENST00000463413
  CDS Start-End: 95-503
tcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacc

SEQ ID NO: 145157 - DNA, 5514 bp, Homo sapiens
  Payload ID: 8682
  Gene Symbol: KLHDC2
  Gene Name: kelch domain containing 2
  Uniprot ID: Q9Y2U9
  ENST ID: ENST00000298307
  CDS Start-End: 862-2082
agaggcggcgcccggcaggggcggcaggagctcaggagaggcccccggggatcgggctgggccccacgtgagagctaagcgactgccctcgcgcccgcagaacagcagggcctgcatcgactctaaggcgagaccagaaacttgctagtggagcaattctggtgcccctgcccgggctgtgaaccctctgagatcatccctcaatcaaacgaatagaaatcctcgggaagaaaaaaaaaattgcggcaatccggctaaaattcagcagctttcagggaccgattcaggacattatccctgtggttccctcagtgaaaggagactcgaagcgcgactagaagtcgccgggccccatagatctgcggtgcccaggccgtaggcggaggcgcgggcagaggcggcggcggcggcggcggcggctggaggacccggcgctgggggcgctgagcggcagcctcgcttccggagctcggcgggcggcgtcagcggaacgggcggcttccggccgcggcgtaaacaaggccgtggactgcaggaggcggggcagacgggctgcaatagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacaccagtagctgtcctctattaaagtaaagtaatggttgggctttttaccctgaagaatggttgctacattttcttttcagtaacttcaggatatgtatctgtagaaacattatagtcttaccatcatcaaaatgctgaagtcattttttgaaaacattatagatttttttttttttaatggcaagagtagtctatagttatgtaacctagtgttgtaaatacaatataataaaggtttttttttttaaacattaatattcacattatgacgaagctggaaaaacaaagtgtggagggaccaacaactgttcagtactttgaccttaatgcttcagtgtaggggctggagcaagtggtcatgctgaatacaggcaggtgctgtccagtcaattaaaaagtttttttttaattaataggttttatagctcatgaaggaatggaaataatgatgacatcattttccattctgttaagagacagaggaaaagtgggttagagtctttagtggtaagcctaaaatgcgcttctggtattataggttaagatactctaacgtgctatattggtaattaattactaaaggtggaaattaaaatggtacagaactgaatcagattacaaggaaaaaattaagatcaaacctgaaggtctacaaatgaatagaaatgattaagctgagtcatgagaattattacttatattttacattttggtctaatatttttttctgacaagtatcaatgaaagcagaagaaaatccactccaatacttagttttcaagacacaatcctaaatatttaaaccccttgtagctggcctataatatatatatattagatgttatatacagtagacttaccaagtcaatagtttaagcaatcaagccacttcactgttcagtttctttacatcatgaaatgaatacttggtattaacctcccaaatttcaagaaaatgtagaataactacagatgtatataattagcatttaactgtccacaaatactttaggaaatcctatcatagtgtttcctctatataaaactgggaaaaaaacaagaattaagtccttttggtgaatatagcaaggcaatgtttagttcatttggcctgtaatatatatattagatgttatatacagtagacttaccaagtcaatagtttaagcaatcaagccacttcactgttcagtttctttacatcatgaaatgaatacttggtattaacctcccaaatttcaagaaaatgtagaataactacagatgtatattaattagcatttaactgtccacaaatacttttggaaatcctatcatagacagtgtttcctctatataaaactgggaaaaaacaagaagtaagtccttttggtgaatatagcaaggcaatgtttagttcatttttataatgcggaaatcctgatacatggtgctttcatctttgaacttccaaaaggctataaaattggctcttctcaaatattttagaatttcatttcagctatttcctttttacgttcagaagattgggtgcagacactttcactttgccaggaatgtttcttgataaatctgtgtcctaaaaaaagaaaattgctgaatatcttcacatcctgtatggtcaatcatgtttcttttatgacaaaaacgaaaaacatttccaaacttttagctgagatggttttactgcttctaataagacagcattttctactaaaataacaaaaaactgctaacattttaaattgtactgtcagtctccacattccttttctgaaggagaactttacctttacgctgcggaataagtctttttctcttgctgttgcttctttggaatgcatgaaactattcaaggctgtttttgcagctgtaaatacaaaaaagagtaagaataatctactgttaagtcactgaactgtttaaaatcataattcaaaaaaacaaatttaaataccttttccctttttctgcactccaggagtaagtttcactttatatctttaaaaaggaattacatgtgttactaaatagacgttacaaaacaattcacaaaagccattctgtcaactaatggtaacttacttgtagtttgtcatggtggtgtaaggggcacatattggaatggcaaacagtagtacatcttcaggatgtggctggcctgtcaaagaatcaaataggttttcctaaaaagggaaaataacagttacaaaggcaatttataccgccctttacaaaaaatgctaaaacacttgaattagtatctcaacatattttttatcttttcctgatatacataccatctaagctggaacagtggtacttaaactctgcttcatagttccaaagagttgaagaccaatgtttaaatatattctttactacttaatttttgcctagcataataagtaatgagaacaataattttcaaaatcctacctacagttacatttaagagaaagaaggcccaggagcagtggttcacgcctataatcctaggactctggaaggctcaggctgaggcgggtggatcgcttgagcccaggagttcaagaccagcctaagcaacatggagaaacaccatctctacaaaaaatataaaagttagctgggtatagtgggtgcctgtagtcccagctactcggaagactgagggggggaggatcacctgagcccaggaggtagacgttgtggagagccatgatcctgtcactgcactgggtgacaccagcctgggtgacagagaccctgtctcaaaaaaaaaaaaaaaaggaaaaaaactattggatattacctgagttgcagaaacctgctgtggattaaaatgatgcaataataaccacaaatagatttaagtcctatcacatggaaatgggactaataccttggctataccactatttctcgtcctggggagattctgccctcagaagacaatgggcaatgtctagagatagttttcgttgacacgatgaggggtgagaaggaataggtaggggctgctactgggatctagtgggtaaaggccgaggatgtcgctaaacattttataatgaatgggacagaccccacaacaaagaattaaccaacccctaatgttaatagtgccaaagttgagaaaccctgggctagaacagccttctctcttacccattattaaggagaaatcccagagttcttatttgctgtgctgcctgtgagattgcccccatttattttacaatatgaataaacttagatttaggacagaa

SEQ ID NO: 145158 - DNA, 1696 bp, Homo sapiens
  Payload ID: 8682
  Gene Symbol: KLHDC2
  Gene Name: kelch domain containing 2
  Uniprot ID: Q9Y2U9
  ENST ID: ENST00000555739
  CDS Start-End: 340-1089
ccgtggactgcaggaggcggggcagacgggctgcaatagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagtaagtattcaaacgacttcaatgacttgcttttgaattcttcaaaatgataacttaattatccttttttaggatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgt

SEQ ID NO: 145159 - DNA, 1565 bp, Homo sapiens
  Payload ID: 8682
  Gene Symbol: KLHDC2
  Gene Name: kelch domain containing 2
  ENST ID: ENST00000557247
  CDS Start-End: 302-1225
gggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagttatggcacacagcttgtgccagcgatgaaggagaagtaattgtttttggtggatgtgccaacaacttgcttgtccatcacagagctgctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaata

SEQ ID NO: 145160 - DNA, 1756 bp, Homo sapiens
  Payload ID: 8682
  Gene Symbol: KLHDC2
  Gene Name: kelch domain containing 2
  Uniprot ID: Q9Y2U9
  ENST ID: ENST00000555443
  CDS Start-End: 302-1051
gggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagtaagtattcaaacgacttcaatgacttgcttttgaattcttcaaaatgataacttaattatccttttttaggatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtt

SEQ ID NO: 145161 - DNA, 1641 bp, Homo sapiens
  Payload ID: 8682
  Gene Symbol: KLHDC2
  Gene Name: kelch domain containing 2
  ENST ID: ENST00000554589
  CDS Start-End: 316-1389
gacgggctgcaatagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaa

SEQ ID NO: 145162 - DNA, 1903 bp, Homo sapiens
  Payload ID: 8683
  Gene Symbol: KLHDC3
  Gene Name: kelch domain containing 3
  ENST ID: ENST00000244670
  CDS Start-End: 592-1338
agaatctctcctacgcccctgcccactcctcagccctctcgtccctcaggaaacgtatggactacaagtcccgaaatgcctccggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcagcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctccaaacgtg

SEQ ID NO: 145163 - DNA, 1909 bp, Homo sapiens
  Payload ID: 8683
  Gene Symbol: KLHDC3
  Gene Name: kelch domain containing 3
  Uniprot ID: Q9BQ90
  ENST ID: ENST00000326974
  CDS Start-End: 196-1344
gcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctccaaacgtg

SEQ ID NO: 145164 - DNA, 1494 bp, Homo sapiens
  Payload ID: 8683
  Gene Symbol: KLHDC3
  Gene Name: kelch domain containing 3
  ENST ID: ENST00000332245
  CDS Start-End: 154-1323
ctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcc

SEQ ID NO: 145165 - DNA, 1663 bp, Homo sapiens
  Payload ID: 8684
  Gene Symbol: KLHDC4
  Gene Name: kelch domain containing 4
  Uniprot ID: Q8TBB5
  ENST ID: ENST00000353170
  CDS Start-End: 10-1401
cccggcaagatgggcaagaagggcaagaaggagaagaagggccgcggcgcggagaagacggccgccaagatggagaagaaggtgtctaagcgctcgcggaaggaggagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaaga

SEQ ID NO: 145166 - DNA, 1886 bp, Homo sapiens
  Payload ID: 8684
  Gene Symbol: KLHDC4
  Gene Name: kelch domain containing 4
  Uniprot ID: Q8TBB5
  ENST ID: ENST00000270583
  CDS Start-End: 60-1622
gcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaag

SEQ ID NO: 145167 - DNA, 1821 bp, Homo sapiens
  Payload ID: 8684
  Gene Symbol: KLHDC4
  Gene Name: kelch domain containing 4
  Uniprot ID: Q8TBB5
  ENST ID: ENST00000347925
  CDS Start-End: 87-1556
ctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaaga

SEQ ID NO: 145168 - DNA, 4444 bp, Homo sapiens
  Payload ID: 8684
  Gene Symbol: KLHDC4
  Gene Name: kelch domain containing 4
  ENST ID: ENST00000446344
  CDS Start-End: 78-953
gcagatgagcagagtcctgctagagaggtcagctcagcgtccaggagggggcgcctgcccccgaggaggccacggacatgcctgggaagttgctgccggagaagtgtgctctgatgtggctacatttggggacgcgggctccccagaggcccaagcgagaaagccgggggttcccaggctgggggtgcaggacgggccaggcactgccctgcagggcccgcccccctgcccctgcaccctcacacccatcttcctctctcagcctgaccccagggcctgggagcccccggcagaccggccctccttgccaaacagtggctgccctttatggactcggcgcctggcagagccactgtggaggaggagttggctgtcatggtcaggggaggcagcccttgggttgtcaaggttggtggtcaacgttgaacccatatctgctggaatctcccggtctgttccacacacgatcatgcgggaagctctgggacccgaaggctgttctgatctcgggggtcacaagttctcacagcagcctggggtcaccagggaccagacccggcgttagcctctgtaaggagctgcctggctgctgggctgagctttgttgcaggcccaggaagatgaccaagaaggacagagcagagccccatctaccactgctgggagggcccgagggagcacgtgcacagcagagccccatcctccactccctgggctcgaagaggcttcctcggtgtggatggcagctgttaacgagcagtggtggtgcagctggaggcctctgtcccatggggcacagacgggagaaggatggcggacgggtgtgcacgcttgggaggacgggcgggcggcataggcctgagcaggtggcatgggcgcacgagaagggtgtgtctgagacaggatgtttatcccaaatgccaggagtggacgaggcggacgagtggcagtgaggtaggcatgtgaggttgttgcctggcccactctgccgaccccagaaacccagcggcctgggcccagcacccggctacacatggggtgagctcacgcccacactgtggcctgtgcccgtcacggggctgcttgcttctcctaggcttgggaacaagctggcatgaacgctgtggccgcattcacagctcaggcacttccactttgggtttcatgaagaaacagacttaaagagcatttgttcctaatgggtgggctgaagcttgggaggagcattcagcttctctccacagtatggcttcacctgttcctgagcgccctgctaccctcttgctaacctgggtggctgaggtcctctgctttggtggcgttgacttcccgtctgcagccagcgccaggtgccagcccccgcctctgctcatcgggaagcgctggcctgcaggtgctttgtggttgccacggacccttgttctgtccctttccagcacccaccccccacgcgctgtgcattccgtagttcattttcaaggcagggggcacatggtgaaaatacagcctggctttttttcaacaaatgcagctgcactcttccttgcttgttttgaaggctgagccagcaacctccttggcacctggggacagtcgcttcctcagtttctgcgtaccgactgcctcacctgacacgcggcctgggcgcgagagaagccaaccaggtgcctgagttgactgactccttccgccctccagcttcctccctccgccctccaacctcctccctccaccctccaacctcctccctccgccctccaacctcctccctctgccctgcaacctcctcccctctgccctccaacctcctccctccgccctccaatctcctccctctgccctgcatcctcctcccctccgccctccaacctcctccctccgccctccaacctcctccctccgccctccaacctcctccctccgccctctgccctcctccctctgccctccagcgttctccctcctccctccaccctgtttcctccctccacctcttctctcctccctccaccctcttccttctaccctcttccctctgccctcttcttctgccctcctccctccaccctctttcctccctcctccctccaccctctgccctcctccctctaccccctgccctcctccctccgccttatctggaatcggggtcttggtcctgggctggaggcagaccctggcccgggcgaggttaaaggtactgcaggagggcggcatcatgatgtcctgaagcttgttgcgcccggtgctgtcggccggctgaaggcagaaacagtcacagcacctgcagctatggaaggcgacgactgaaaatctaataggcaccttgatgtcaagtttccaagaccaaaggcaagaacagtcagatcaaacttcggaagagtcagagaaagtgagcatgacctagaggagggagacggtccttccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctgcttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactgg

SEQ ID NO: 145169 - DNA, 528 bp, Homo sapiens
  Payload ID: 8684
  Gene Symbol: KLHDC4
  Gene Name: kelch domain containing 4
  ENST ID: ENST00000563845
  CDS Start-End: 72-206
acctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagagggcaaataatcatcacagcagccctgagcagtgagcagcagatggttaagtgaagaaggcactggagccacggggtatcccgtagcagctgatggcggccatcacggttgtctccttccctctggtcctcagcccggggtctgcaggaggatccgtcctgaccttggggttgagtgttctgcggctgctgctcatggattccctaaccggggccagttttatggcctgccgtgcgccaggcacagctccctgggctttactcctcacgagcaggaagacctggaagcgctcatagcccatttccagacactcgatgccaagaggactcagactgtggaacttccgtgccccccacc

SEQ ID NO: 145170 - DNA, 563 bp, Homo sapiens
  Payload ID: 8684
  Gene Symbol: KLHDC4
  Gene Name: kelch domain containing 4
  ENST ID: ENST00000564396
  CDS Start-End: 72-332
acctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacagg

SEQ ID NO: 145171 - DNA, 560 bp, Homo sapiens
  Payload ID: 8684
  Gene Symbol: KLHDC4
  Gene Name: kelch domain containing 4
  ENST ID: ENST00000569747
  CDS Start-End: 78-395
acgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcgga

SEQ ID NO: 145172 - DNA, 1065 bp, Homo sapiens
  Payload ID: 8684
  Gene Symbol: KLHDC4
  Gene Name: kelch domain containing 4
  ENST ID: ENST00000562261
  CDS Start-End: 62-1065
gagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccc

SEQ ID NO: 145173 - DNA, 1757 bp, Homo sapiens
  Payload ID: 8684
  Gene Symbol: KLHDC4
  Gene Name: kelch domain containing 4
  ENST ID: ENST00000562155
  CDS Start-End: 40-339
tctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttg

SEQ ID NO: 145174 - DNA, 584 bp, Homo sapiens
  Payload ID: 8684
  Gene Symbol: KLHDC4
  Gene Name: kelch domain containing 4
  ENST ID: ENST00000568338
  CDS Start-End: 103-219
atttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagacctggaagcgctcatagcccatttccagacactcgatgccaagaggactcagactgtggaacttccgtgccccccaccctcaccaagatggaatcttgctctgtcgccaggctggagtgcaatggcatgatctcagctcactgcaacccccaactcccaggttcaagtggttctcctgcctcagcctcccgagtagctgggaccataggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctca

SEQ ID NO: 145175 - DNA, 4572 bp, Homo sapiens
  Payload ID: 8684
  Gene Symbol: KLHDC4
  Gene Name: kelch domain containing 4
  Uniprot ID: Q8TBB5
  ENST ID: ENST00000567298
  CDS Start-End: 83-1645
gccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctgcacgtttcctgctcgaaaaccaggagagcctccacgtgccgactagctctgtccacacatccattgcgcagctctgcagcggaaggaccttcagtaaagacgctgcctgaccccagggcctgggagcccccggcagaccggccctccttgccaaacagtggctgccctttatggactcggcgcctggcagagccactgtggaggaggagttggctgtcatggtcaggggaggcagcccttgggttgtcaaggttggtggtcaacgttgaacccatatctgctggaatctcccggtctgttccacacacgatcatgcgggaagctctgggacccgaaggctgttctgatctcgggggtcacaagttctcacagcagcctggggtcaccagggaccagacccggcgttagcctctgtaaggagctgcctggctgctgggctgagctttgttgcaggcccaggaagatgaccaagaaggacagagcagagccccatctaccactgctgggagggcccgagggagcacgtgcacagcagagccccatcctccactccctgggctcgaagaggcttcctcggtgtggatggcagctggagtggacgaggcggacgagtggcagtgaggtaggcatgtgaggttgttgcctggcccactctgccgaccccagaaacccagcggcctgggcccagcacccggctacacatggggctgagccagcaacctccttggcacctggggacagtcgcttcctcagtttctgcgtaccgactgcctcacctgacacgcggcctgggcgcgagagaagccaaccagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctgcttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactg

SEQ ID NO: 145176 - DNA, 564 bp, Homo sapiens
  Payload ID: 8684
  Gene Symbol: KLHDC4
  Gene Name: kelch domain containing 4
  ENST ID: ENST00000566561
  CDS Start-End: 72-206
acctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagagggcaaataatcatcacagcagccctgagcagtgagcagcagatggttaagtgaagaaggcactggagccacggggtatcccgtagcagctgatggcggccatcacggttgtctccttccctctggtcctcagcccggggtctgcaggaggatccgtcctgaccttggggttgagtgttctgcggctgctgctcatggattccctaaccggggccagttttatggcctgccgtgcgccaggcacagctccctgggctttactcctcacgagcagatggagtcctgctctgtcacccagagcaagtgtcgcagtggcatgatctcagctcattgcaacctctgcctcccaggctcaagcaattctcctgcctcagcctcccgagtagtttggga

SEQ ID NO: 145177 - DNA, 562 bp, Homo sapiens
  Payload ID: 8684
  Gene Symbol: KLHDC4
  Gene Name: kelch domain containing 4
  ENST ID: ENST00000561825
  CDS Start-End: 42-562
tttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagcccggggtctgcaggaggatccgtcctgaccttggggttgagtgttctgcggctgctgctcatggattccctaaccggggccagttttatggcctgccgtgcgccaggcacagctccctgggctttactcctcacgagcaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagt

SEQ ID NO: 145178 - DNA, 1422 bp, Homo sapiens
  Payload ID: 8684
  Gene Symbol: KLHDC4
  Gene Name: kelch domain containing 4
  ENST ID: ENST00000622456
  CDS Start-End: 646-1422
atttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttag

SEQ ID NO: 145179 - DNA, 5145 bp, Homo sapiens
  Payload ID: 8685
  Gene Symbol: KLHDC7A
  Gene Name: kelch domain containing 7A
  Uniprot ID: Q5VTJ3
  ENST ID: ENST00000400664
  CDS Start-End: 1-2334
atgttccccagaggagcagaggcccaggactggcatttggatatgcagctgaccggcaaggtggtgctgtcagccgctgccctgctcctggtgactgtggcctacaggctgtacaagtcgaggcctgccccagcccagcggtggggtgggaatggccaggcagaagccaaggaggaagcagagggctcagggcagcctgctgtacaggaggcttctcctggggtgctcctgagggggccaagacgtcggaggagcagcaagcgggctgaagcaccacagggctgcagctgtgagaatccaagaggcccctatgtcctggtcacgggggccacttccacagacaggaagccccagagaaaaggctcaggtgaggagcggggcgggcagggctcggactctgagcaggtgcctccttgctgccccagccaggaaaccagaacagctgttggcagtaaccctgaccctccccatttcccccgcttgggcagcgaaccgaagagctccccagctggactcattgcagcagccgacggcagctgtgccggtggtgagccttctccatggcaggacagtaaaccccgtgagcatccaggactggggcaactagaacctccccactgtcactacgtggctcccttgcaaggcagcagtgacatgaaccagagctgggtcttcacccgtgtgataggggtcagcagagaagaggctggggctctcgaggctgcctccgatgttgacctgaccctgcatcagcaggagggcgcccccaactcctcctataccttctcatccatagcccgcgtccgaatggaggagcatttcatacagaaggcggagggggttgagccccggctcaagggcaaggtgtacgactactatgtggaatctacctctcaggccatcttccagggcaggctggctcccaggacagcagccctgactgaggttccatcccctaggccaccgccagggtccctgggaacaggggctgcctcgggaggccaagccggtgacacaaagggtgcagccgaaagagccgcctccccgcagacagggccgtggccctccacccgaggcttcagccggaaggagagccttctgcagatagcggagaacccagagctgcagctgcagccagatggcttccggctccccgctccaccctgcccagacccgggcgccctgcctggcttaggcagaagcagccgggagccccatgtgcagccggtggccgggaccaatttcttccatatcccgctcacccctgcttcagccccacaggtccgcctggatctgggcaattgctatgaggtgctgaccttggccaagaggcagaacctggaggccctgaaagaggcggcctacaaggtgatgagcgaaaactacctgcaggtgctgcgcagcccggacatctacgggtgcctgagcggggcagagcgcgagctgatcctgcagcgccggctccggggccgccagtacctggtggtggctgacgtgtgccccaaggaagactccggcggcctctgttgctatgacgatgagcaggatgtctggcgcccgctggctcgcatgccccccgaggccgtgtcccggggctgtgccatctgcagtctcttcaattatctcttcgtggtgtccggctgccaggggcccgggcaccagccctccagccgcgtcttctgctacaacccgctcacggggatctggagcgaggtgtgcccgctgaaccaggcccggccgcactgccggctggtggccctggacgggcacctgtatgccatcggcggagagtgtctgaactcggtggagcgttacgacccccgcctggaccgctgggactttgccccgccgctccccagtgacacgttcgccctggcgcacacggccacggtgcgtgccaaggaaatcttcgtcaccggcggctcgctgcgcttcctgctgttccgcttctctgcgcaggagcagcgctggtgggccggccccaccgggggcagcaaggaccgcacggccgagatggtggcggtcaacggctttctctaccgctttgacctcaaccgcagcctgggcatcgccgtgtaccgctgcagcgccagcacccggctctggtacgagtgcgccacgtaccggacgccttacccggatgccttccagtgcgccgtggtggacaacctcatctactgcgtgggacgccggagcaccctctgcttcctagcagactctgtctcacccaggtttgtgcccaaggagctgcggagtttcccggccccgcagggcaccctcctgcccaccgtcctgaccttgcccacccccgatttgcctcagaccagggtctagcagtccctcaactgagctcctcatgcaaagctgggggccaccgggctccactgccagccgtccctctgggggccatttctaggcaaacaggcaacccaggaatgtggccatcaagaggtgaattccggtcctttctcctcccctagctggggagagagggatcttagatgagtcttacccttcatgggctgcagaggccccactgcagaaaagaggaccaggagctggtgttccaaggcagaaggcattcatgtcttcagggatgaccgcccttgcttcaactctgaattcttggggggatacaccgggaccccaccaaagcttagggggcatagtctttttgcaatcacaattctaggagccagttgaccccagcagcccctcgctagttgctctggagaggggttggctctctgagccatcagtgccccttcctaaacatcagccactgggccccacctccacagttcccagaagcaccgggacacacaggtgggaaagatggaggcaggtgacttgggcagggccaggaaggagccgagggagccccaggggccctggccagagggagtggtggtttgaaaagtagaacagctgaagctggggccagcctaggagactcttgcttgcgagaaaatataccaaagcccacattacttttctccttattggaagaaagagaagcagccattgtaccaagctatcttctggtggaggtctgctaaggatacacggaggtctcagcaaagggaagaaactatgtgatccaagggccaccctgctcctcggccctgcccatgttaactgaccattgcactcattctcagatctgtagccgtcttcctgtctggaagctggggcaaccaccaccagtcagcacttcagggtgacagcataatttgccctccttgtgccaggtacggtcacctggtttgccgcattcacattttcaggtggatgaccaagcggaggaactagaagagtctagtgaagcatccagagactggatctcctttcacatctggtttgataaactccgaatgaaggagacccccagcctcaggaaagcacctgtccttccaggagggacgggagagagcctgacccagtgtattaccacagcccttgttccacctctgagggagacagtgacagatgggaaggcagtgatgctcttggtcccagccagaagccaggggagatgggaggtacaccagagcagggcctgacaaggaagaaaataaggatgctttggacctcagtgtccttgtcttgaaaatgggaaggacaattcatgtccctgtctgccctggggataaatgagaggataaaagagaaagttcttcccagtttcccaggtggtcccagctagatcctgtgtccacggaagctgctggtgcccaggctgtgggtcttgttggaagaagcaggactggaacaaaggatgaaaaggaggttggcatggacataagaggagagcttgcactggaccaccgaagaccaccatccctggtctgggctctggcaccaggctctgccagtggcagctcagaggccacagggtgacattggccacacccccaccccacttccctggcctgggcctcgaaagatgaagcaactgaatttattcttaaatcagagaccaggaagggaaagtcagctggggccatggctaccttcttgggagagtgacccctgaacccagccaaggccacattcaagctcagtgtcaacactaggcatgaacctccaagggacctgtgggctggggcagaatggcttcagtgacaagactcaaaggaggcactagcattgtgctgctggactgggggaaggacttgcttgggaggagaactctacataggagctgggggcaggtggacctagatccaaccttcaacccctagtgaggggccaggcagaggacaaggcaacaactaagctaggtaaagttctggaaagtttccaagcccaggaggaacaaggaccactctggaaaaacattccaaagcccattgcatacctgtggtagagactaggggagtgattccagggataagacggacaaatgtgttccaggccccagctgatggtgggtgtggtcttcataatgagaggtggagctgagatttgggcctgggctgggaagaggagtacacagtccatctgatccacctctcttatggttccattggcaaaatcattcatcagtcgtcctatcttttcctggcgagcgctcacaatggcttcataagtgtttcaatacagtgtcccaggcagtcactacctatagattagagctgatgtgctggcctggggctctagagctgggcttcaggaagaatgtggtcagggccatcagggtggaacaaggtagctcaagaccttggaaagacaccctgagggcacaatcgtccttgcagtttaagatgacactttaaaaataaattctttcctaatgatggcttgagtcctgccactcaatgggagcatcagcggaacccgtagcatcttatttggaattgacattctctattgtaattttgttcctgtttatttttaagttttctttttgtttcactggaaaggaaagatgatgctctgttttaaacattaaaagtatacaagttgctttgttacaataaaactaaatatgtacacacaccaaaaaaaaaaaaaaatgatcaggatgcattcattcactcctgaaataaacatttacagaatatttggactgggcagtgttctaggtgctggagatgcagcagatccctgccttaatggagctcacattctagcaaaggaaaa

SEQ ID NO: 145180 - DNA, 2991 bp, Homo sapiens
  Payload ID: 8686
  Gene Symbol: KLHDC7B
  Gene Name: kelch domain containing 7B
  Uniprot ID: Q96G42
  ENST ID: ENST00000395676
  CDS Start-End: 135-1919
ccacctcagccccaaccccaaccccagccgcatcccctgccccagctgacgggtcaaagcctcaggagagtgtggctctccccaggcgctaccaggaggggcaggtctcagccagctggggaaaccttattgccatggttcttagaagccaccccttccccaggcaagacaggccccaagggagtgtcccgagggcggttcccgggagccccgtgggtcccagcacttccacacactctgaggacagacacggcccctcttcttcagtggggacagtcatagggacaggtacagggggcctggttgaggctggaggtcagccacagccaagaagctccgagaccaacggatcgcccagcccagaccctcccccaggcctaagaggagagggaaccagggagaaaagtctagacccgctgccccaagccgcgatgcccaggggccccgcacagccccccgcgcagaggccgcctggccccgcggcctcctcctctgcgaggcgctcacagccggtaccccagctacggaaacgcagcaggtgcgaaatcgccccgagctcggagcaggaggtcaggccggccgcctcgggggaccctcaaggggaggcgccgggggaggggggcagccctgccggccgcagcggggcgctcacggaaaagcaggaggaggcccggaagctcatggtgtttctgcagaggcccgggggttggggggtggtggaggggccccggaagcccagctcccgggccctggagcccgccacggcggcagccctgcggcggcggctggacctgggcagttgcctggacgtgctggcctttgcccagcagcacggagagcccggcctggcgcaggagacctacgcgctgatgagcgacaacctgctgcgagtgctgggagacccgtgcctctaccgccggctgagcgcggccgaccgcgagcgcatcctcagcctgcggaccggccggggccgggcggtgctgggcgtcctcgtactgcccagcctctaccaggggggccgctcagggctccccaggggccctcgtggcgaggagcctcctgcggcggcccctgtgtccctgcctctacctgcgcacctgcatgtgttcaacccccgggagaacacctggcggcccctgacccaggtgcccgaggaggccccgcttcggggctgcggtctctgcaccatgcacaactacctgtttctggcggggggcatccgtggctccggtgccaaggccgtctgctccaacgaggtcttctgctacaaccctctgaccaacatctggagccaggttcggcccatgcagcaggcccgagcccagctcaagctggtggccctggacgggctgctctatgccatcggtggcgaatgcctgtacagcatggagtgctacgacccgcgaacagacgcctggaccccacgcgcgccactccccgcaggcaccttccctgtggcccacgaggctgtggcctgccgtggggacatctacgtcaccgggggtcacctcttctaccgcctgctcaggtacagccccgtgaaggatgcttgggacgagtgcccatacagtgccagccaccggcgttccagcgacatcgtggcactggggggcttcctgtaccgcttcgacctgctgcggggcgtgggcgccgccgtgatgcgctacaacacagtgaccggctcctggagcagggctgcctccctgcccctgcccgcccccgccccactgcactgcaccaccctgggcaacaccatttactgcctcaacccccaggtcactgccaccttcacggtctctggggggactgcccagttccaggccaaggagctgcagcccttccccttggggagcaccggggtcctcagtccattcatcctgactctgccccctgaggaccggctgcagacctcactctgagtggcaggcagagaaccaaagctgcttcgctgctctccagggagaccctcctgggatgggcctgagaggccggggctcagggaaggggctgggatcggaacttcctgctcttgtttctggacaactttccccttctgctttaaaggttgtcgattattttgaagcccagactccctcagcctctttctgcccctcactccacacccagactgtttcctgactcaattccgtacctacttacagaccctctcagcttgctgacacccccctgtctgtgggactccctattccctagagccagggactgatgcgtctccacagacaaggacttggctcgctggagctctgctgagccgagagaggagggggtagaaaacattcacacttcctatgctctgtcagcaggacagggagcaaaaacgtccccaggcaacgccctcgcctctgggactttctgcctgtcctaaggcctccccaggtaccaaccccgtagctatctgggtctgtttggcactgtggattctcaagggcctagaacccttgcctctgaaactggtccgctggtgcagccctgctgtctgcagctcctgcccatacccccagcccacaccaggccaggcccactccgggctcaccaccctctgcagccttgtggggctctcccagcccctccagaagcccaccccacttctcgccaacccccgatctctaaatgaggcctgagcgtcaccctagttctgcccctttttagctgtgtagacttggacgagacatttgacttccctttctccttgtctataaaatgtggacagtggacgtctgtcacccaagagagttgtgggagacaagatcacagctatgagcacctcgcacggtgtccaggatgcacagcacaatccatgatgcgttttctccccttacgcactttgaaacccatgctagaaaagtgaatacatctgactgtgctccactccaacctccagcctggatgtccctgtctgggccctttttctgttttttattctatgttcagcaccactggcaccaaatacattttaattcaccgaaagca

SEQ ID NO: 145181 - DNA, 2928 bp, Homo sapiens
  Payload ID: 8687
  Gene Symbol: KLHDC8A
  Gene Name: kelch domain containing 8A
  Uniprot ID: Q8IYD2
  ENST ID: ENST00000367155
  CDS Start-End: 569-1621
ctttgcagctgagactgggtggagggagaggcgcggagacactggggctctgacgagctggctgaggccctctcagtaggggggtcacgcctcctggaactcagggaccccaagtttctgtgcattcagggcggggctggccccatgccctgtgcataggggcctggctgcatcccagtcgatcagccagaggcagcagcagtggactcatcaattgtggaggaagccctggggaccctggggaccttgccgactctattcccagccagctcctaggacaagcctcagagccaacacccgctcgaccctctcccggcccctccccttctttgtcttttgcagatgatcgccgggtgtcgatccttttccctccagtcagggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatgttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaatgtgcctcctcttagcatctgtttctgactcccagttatttttaaaataaatgatgaataaaatgcctgccctgaa

SEQ ID NO: 145182 - DNA, 3177 bp, Homo sapiens
  Payload ID: 8687
  Gene Symbol: KLHDC8A
  Gene Name: kelch domain containing 8A
  Uniprot ID: Q8IYD2
  ENST ID: ENST00000367156
  CDS Start-End: 818-1870
ttctctcccatctggcagaggagtccggctccctaaatcttctttttgttgatgatcgccgggtgtcgatccttttccctccagtcagatgaggacactcagattcaaggacataagtgactggtgcataatcacacagctaggaggtggctgcaccaggattcagatgcagcctgtctgatgctgaccacatggtctgtggggtgctgcagaaagaaaactgcataaagaaggtgatcctggcctcggggagttcctggtgtgtgcctccagccagcgtggtaccctgcagagggcactccgacaaggtgagcgcttccgcggcggggcttctgtacagaggtcacagcacgctgtgtcccgggacgcacgcggattcctgcacaggtgtggtggctgcggatggggacggagcggagcaggctcgccggcctcctccccggcggcggctccgcttctccttcctgctgttcacttcatctcctcatctgcatgtgtgacagcggcgcgcggactggggaaggacagagcgccctctccccggctcccgtgcagcggggcgggggctccgggctccccagtgatgcgtcgtctgcgcctcgccgccgcgctccccgggcctggcagcggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatgttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaatgtgcctcctcttagcatctgtttctgactcccagttatttttaaaataaatgatgaataaaatgcctgccctgaa

SEQ ID NO: 145183 - DNA, 2931 bp, Homo sapiens
  Payload ID: 8687
  Gene Symbol: KLHDC8A
  Gene Name: kelch domain containing 8A
  Uniprot ID: Q8IYD2
  ENST ID: ENST00000539253
  CDS Start-End: 545-1597
tttgcataactggcagcgttgcaaaggacagcccctttctctcttccctccattctctcccatctggcagaggagtccggctccctaaatcttctttttgttgatgatcgccgggtgtcgatccttttccctccagtcagatgaggacactcagattcaaggacataagtgactggtgcataatcacacagctaggaggtggctgcaccaggattcagatgcagcctgtctgatgctgaccacatggtctgtggggtgctgcagaaagaaaactgcataaagaaggtgatcctggcctcggggagttcctggtgtgtgcctccagccagcgtggtaccctgcagagggcactccgggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatgttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaatgtgcctcctcttagcatctgtttctgactcccagttatttttaaaataaatgatgaataaaatgcctgccctgaagggttctggaggagtcaggtatcactc

SEQ ID NO: 145184 - DNA, 566 bp, Homo sapiens
  Payload ID: 8687
  Gene Symbol: KLHDC8A
  Gene Name: kelch domain containing 8A
  ENST ID: ENST00000607173
  CDS Start-End: 330-566
tttgcataactggcagcgttgcaaaggacagcccctttctctcttccctccattctctcccatctggcagaggagtccggctccctaaatcttctttttgttgatgatcgccgggtgtcgatccttttccctccagtcagggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaag

SEQ ID NO: 145185 - DNA, 948 bp, Homo sapiens
  Payload ID: 8687
  Gene Symbol: KLHDC8A
  Gene Name: kelch domain containing 8A
  ENST ID: ENST00000491471
  CDS Start-End: 751-948
cggagacactggggctctgacgagctggctgaggccctctcagtaggggggtcacgcctcctggaactcagggaccccaagtttctgtgcattcagggcggggctggccccatgccctgtgcataggggcctggctgcatcccagtcgatcagccagaggcagcagcagtggactcatcaattgtggaggaagccctggggaccctggggaccttgccgactctattcccagccagctcctaggacaagcctcagagccaacacccgctcgaccctctcccggcccctccccttctttgtcttttgcagatgatcgccgggtgtcgatccttttccctccagtcagatgaggacactcagattcaaggacataagtgactggtgcataatcacacagctaggaggtggctgcaccaggattcagatgcagcctgtctgatgctgaccacatggtctgtggggtgctgcagaaagaaaactgcataaagaaggtgatcctggcctcggggagttcctggtgtgtgcctccagccagcgtggtaccctgcagagggcactccgggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgccc

SEQ ID NO: 145186 - DNA, 606 bp, Homo sapiens
  Payload ID: 8687
  Gene Symbol: KLHDC8A
  Gene Name: kelch domain containing 8A
  ENST ID: ENST00000606181
  CDS Start-End: 80-606
gtcttgctgtacctgtgagctaagccaggggcatgtatggcctttcttcttagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccc

SEQ ID NO: 145187 - DNA, 1022 bp, Homo sapiens
  Payload ID: 8687
  Gene Symbol: KLHDC8A
  Gene Name: kelch domain containing 8A
  ENST ID: ENST00000460687
  CDS Start-End: 288-938
cttttgcagatgatcgccgggtgtcgatccttttccctccagtcagatgaggacactcagattcaaggacataagtgactggtgcataatcacacagctaggaggtggctgcaccaggattcagatgcagcctgtctgatgctgaccacatggtctgtggggtgctgcagaaagaaaactgcataaagaaggtgatcctggcctcggggagttcctggtgtgtgcctccagccagcgtggtaccctgcagagggcactccgattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggc

SEQ ID NO: 145188 - DNA, 523 bp, Homo sapiens
  Payload ID: 8687
  Gene Symbol: KLHDC8A
  Gene Name: kelch domain containing 8A
  ENST ID: ENST00000607826
  CDS Start-End: 275-523
agtgatgcgtcgtctgcgcctcgccgccgcgctccccgggcctggcagcggccaggcgtggacgccgccggaccgctgagactcggggcacggtgaagcactggccggggtctggctgggtccggcgctcgggagccagatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccga

SEQ ID NO: 145189 - DNA, 571 bp, Homo sapiens
  Payload ID: 8687
  Gene Symbol: KLHDC8A
  Gene Name: kelch domain containing 8A
  ENST ID: ENST00000606887
  CDS Start-End: 493-571
ttctctcccatctggcagaggagtccggctccctaaatcttctttttgttgatgatcgccgggtgtcgatccttttccctccagtcagatgaggacactcagattcaaggacataagtgactggtgcataatcacacagctaggaggtggctgcaccaggattcagatgcagcctgtctgatgctgaccacatggtctgtggggtgctgcagaaagaaaactgcataaagaaggtgatcctggcctcggggagttcctggtgtgtgcctccagccagcgtggtaccctgcagagggcactccgggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgc

SEQ ID NO: 145190 - DNA, 1959 bp, Homo sapiens
  Payload ID: 8688
  Gene Symbol: KLHDC8B
  Gene Name: kelch domain containing 8B
  Uniprot ID: Q8IXV7
  ENST ID: ENST00000332780
  CDS Start-End: 210-1274
agccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgcagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaaccta

SEQ ID NO: 145191 - DNA, 1314 bp, Homo sapiens
  Payload ID: 8689
  Gene Symbol: KLHDC9
  Gene Name: kelch domain containing 9
  Uniprot ID: Q8NEP7
  ENST ID: ENST00000368011
  CDS Start-End: 143-1192
cgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 145192 - DNA, 1333 bp, Homo sapiens
  Payload ID: 8689
  Gene Symbol: KLHDC9
  Gene Name: kelch domain containing 9
  Uniprot ID: Q8NEP7
  ENST ID: ENST00000392192
  CDS Start-End: 143-1009
cgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaagtcctttctttctccccaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 145193 - DNA, 6710 bp, Homo sapiens
  Payload ID: 8690
  Gene Symbol: KBTBD11
  Gene Name: kelch repeat and BTB (POZ) domain containing 11
  Uniprot ID: O94819
  ENST ID: ENST00000320248
  CDS Start-End: 967-2838
agcccacccgcctggctgcgcgtcccgggcccggcggctgaagaggagccgcggcgaggaacaagagtgtggtgagaggacgcggaaacacctgatatcccagcaaaggaagctgcagaggaagggtcctgccccgtgagcgaggacagcctccaggagcacagcggcttctcctaacatccccctggcagtgaattacggatgaccccgtatatgaggaggtgtggatgccgacacacggggagagctcctgagaccagcacacaggaccagtgtcctccccgtgaccttgcagttgtgtagccacaagtgggagccacagagaaggagagcccataaggggactcttttcaagacacggtgttaaatcaaggctctgaagttggggccacagccggtctcagctttctgtgttctgggggcgcggtgatatgacagcatgtgaagtgagtgggtgagcacggactcctgagagcgagggcgcacccaatacctggttatctggtactgcagagagacacctagtcagccagcgttgcaaagagggatagctagtcactcaggctgcagagagagacacctggtcacccaggctgcagaaacaaccgcagtcaactgcagctccagtcattgctggatgttggctgacgcggtcctggcgccagctggagatccattcaccaagactttctgggcagatttaaagtggctggggttcagaagttcagcaagtcggacacacccctcctcgctggagaggagagggcaaaggcgaggcgggggagcagcgtgtgagattccccccttcacacacacaacaacaaagcgtggacacacagaagtgaaatctgatcgcgtgccaggaaaagctgtgaggctggaaaccccggagtaaggctcgaccttggccagacctgcaggctgcggaaccgggggcgcgcgggcgcagcgcagcacagcccggccatggagcacgcggtggccccctgcgtcctctacccagggactgagcccggggctgccggggagagcgagagcgagggcgccgcgtccccggcgcagacaccctgcagtctcggcgcgtccctgtgcttcagctccggggaagagtccccgccgcagtccctcgcctcagcggcggaaggcgcggccacctccccgccctccagcggtggcccgcgggtggtggagcggcagtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgctggaggtgtcggggcgccggctgcgcgcgcacaaggcggtgctggcggcgcgcagcgactacttccgcgcgcgcgcgtcgcgggacgtgctgcgggtgcagggagtgagcctgacggcgctgcggctgctcctcgccgacgcctacagcgggcgcatggcgggcgtgcggcccgacaacgtggccgaggtggtggccggcgcgcgccgcctgcagctgcccggcgccgcgcagcgcgccaccgacgccgtggggccgcagctgagcctggccaactgctacgaggtcctgagcgcggccaagcggcagcggctgaacgagctgcgcgacgccgcctactgcttcatgagcgaccactatctggaggtgctgcgcgagcccgccgtgttcggccgcctgtcgggcgcagagcgggacctgctgctgcgccgccgcctgcgcgccggccgcgcccacctcttggccgcggcgctcgggccggcgggggagcgcgcgggcagccggcctcagagcccctcgggggacgcggacgcgcgcggggacgcggccgtctactgcttccacgcggcggccggagagtggcgcgagctgacgcggctgcccgagggcgcgccggcgcggggctgcggcctgtgcgtcctctacaactacctcttcgtggcgggcggcgtggcgcccgcgggccccgacggccgcgcgcgcccgtccgaccaggtcttctgctacaacccggccacggacagctggagcgccgtgaggcccctgcgccaggcgcgctcgcagctgcggctgctggccctggacggtcacctctacgccgtgggcggcgagtgcctgctcagcgtggagcgctacgacccgcgcgccgaccgctgggcccccgtggcgccgctgccccggggcgccttcgccgtggcgcatgaggccaccacctgccacggcgagatctacgtgtccgggggctccctcttctatcgcctgctcaagtatgacccgcggcgcgacgagtggcaggagtgcccgtgcagcagcagccgcgagcgctcggccgacatggtggctctcgacggcttcatctaccgcttcgatctgagcggcagccgcggcgaggcgcaggcggcggggccgagcggggtcagcgtgtcccgataccactgcctggccaagcagtggagcccgtgcgtcgcgcccctgcgcctccccggcggccccacgggcctgcagcccttccgctgcgccgccctggacggcgccatctactgcgtgagccgcgcgggcacctggcgcttccagcctgcccgggaaggcgaggccggcggcgacgcaggccagggcggcggcttcgaggcgctgggcgcccccttggacgtccggggtgtgctcatcccgttcgctctcagcctgcctgagaagccgccccgaggggagcagggcgccccgtaggccggcggggtcggcgggcgtctccctcggcaggggtttgcggggcccaggtccctttgggcccgcggaggaggacgtggtggggagtcggggccgctggccacgctggtggtttggacacttcgaaggagccccgaggacgctctcagggccgctttcgctttgctttccttttgcttgtctttgcttctgggggtggatgccttgagacccaggaggtgtgcggatgggtcccttgacagacaggacacagagaaggctgtgggatccaaagggtcagcctcagggtacagtgggggttcctgaggcagcctgcagccggccccggggtgtcccgaaccccgcagagcaccgaggctgtgcgcaggagcctgggaccctcaagtaggtcgccgcgaactatcgggggaagcacgcagagagggtcacgccttttatttttggcttgagatttaaaattataactgataagtaaagctctttctgatttagttgaaaatttcgtaccatgtgctcgctttggttggctcaactccaaaaagagtaatttaataagcattaaaggtaaaatctttgattaccagtaaggtttcttgttcaatatgcattggaagtatttccttccccacaccattgctactcaaactcacatgcctagagcagctccgtctcactgttggaccgagggggctttcatattttcagttgaaaggatgttaactgatgtagcgatgatttaccattatttaaattttaagtcttcagtggctaaatgtgaccaaacagcacatcataagtaggaaaaacttaccagggtgcttgtctatctaaaaagcaatctttgatagtccactctgtatgcccagccgctttcataatctggaacgagataaaatattcctaaaaagcggggaaaatcattttgctttgacagttctataaaaaaaagtgtaggcacattttaaacccactgtatatgatgttttcaatgtggatcgtgtagttctgatgagggagattaatttttacaatcagtattctaagtgtggccgagtgacagtgggcatagatttataacaaggaagtgacgtgcttatcaccatagatttgcaagtaaactgcatgtatttaattgtattgaattgagttccaaaataccctaatagaattaacacgaggctcactgcattgacagggtatgaggattaaaaacaaatcagttgggtcgtttctcatttaacattttacttttcaagtgtgtatacagaggacttactattatgactttgaggatgagatccatgctcacaaatagaggcgaacatttgaactccgaatccaacccattttcttactgtaagaggaaaagttactggaacgtaactagttgaaatcctgcctactttaatattatttgtttgttaatccagtaatgggaactgccatctctgtagaaatcagtgggtaattgaaaaataggttatgctttttaaagagtctgtggttatgagaggtctcagttaagtgtgtttagaagtgatcagcttgaaccttatgcatgactcgggggctggaatttatgatctgggttacggtatgttctggggacgtgtctgcttgcccatggttactcatgaactgaggggatagcttggcaacttggttaatcatcttgggaaagaaaaacagacttcatatcgcctgacttgattggccttttataggagtatactggagaaatggttgtagaaacagtatttacagcaaaaggaaacaaataatgttcattttaagcaatgtaccattcacactgtcctgccttttcctctagaattttattaatggtagaaatttttatatgaaatgggaccaggaccaggctaatattttcagtccttaaatatcaaactcatatgctgttatcactgtgattttacttgtgaaatcattcctgtaatgtttattgtttgaaaatgaaatattgaaattaggcttccagagtaacactgtccccggaaaaggatatgagaagtggtggatgttggatgggggtggttgcacagtcctgtgcggttcccatggctttccagcgtttcatttagtgaaggaatgctcacactagatgtagcacagcttcctgtggggcccggcagcaaagccccaggtgctccctgtcacctcacaacaaaatgcactaagaaacgtaaagaataagaggaattaatacccaccattaaaggatgtccggccaacctattgtggaaatttatagaatagtatacaccacagttctgaatagtgatatcacataaaaatacatactagaggacctgccacgccatgagcagtgtttttgctttttgggggccagtccctggggtgtggagccgctagggtttgcacccatgaaacagagaaaagccacaccctccaaggtgtggctttcattttgggactgctgcagggagggcagaggcattgctgagactgcctggcaacggctgatgccccaggtaggaccttttccaattcaaagtggtgttctaagtctgcgtccaacactgtgtaggaaaaaggttggtgcaaaaatattcctggtcatccacccattaaaatagttagatgaggctattgccttgatgacagctgtccacactcctcatgaaattaacccgtatgccggggcatttccaaatgtctgactcgtgaaattaacccatacgcaggggcctttccaaatgtctgaaaaggcagtggtgtcttttggggaaaatgttatgcatggaagcctgaccttttgcttagttgacagcaatcccttctgtattgccaatcaaggttcatttgagatgcagaggaatgagcttgagccttcctccttttccttccggttttattcttcctcttgggaacatccctccactccgcactgcttcctgcagctttgtagagctggatttggaacttcgggatttggtttctgagtctgtggaggcaccgacttctgctgtaagaaaatgaatgttgtggaaattctttggctacttaactaaaactcgtgactgtataagtttggctacaaataagtaagaaattaatcatctgctctgtttctgctaatttctggtgtcacttcagtaattctggtagcagccgttgaatctgtcagtctcttaggtaacttcctgtaaacgatttggaaataggatgttttcaacgttcttttgtcttttgctgaagtcaggatagattcaagacataatctcttgtaagatctaaatagagcaaatgtaaacaaaagtgcatttttgtattcttgttaattttagatgctttcctagcttacaaaaagttctgtttttgggttaaaaatcaatcaactttctgatatttccccttctgcaatgttattgttcataagaaaacacgagctgaaaatggaaatctgcagttgtttcagttgtcttgaatttctttcagtggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatgaaataaatcacgcagaaagtgccagtc

SEQ ID NO: 145194 - DNA, 6710 bp, Homo sapiens; identical to SEQ ID NO: 145193
  Payload ID: 8690
  Gene Symbol: KBTBD11
  Gene Name: kelch repeat and BTB (POZ) domain containing 11
  Uniprot ID: O94819
  ENST ID: ENST00000617214
  CDS Start-End: 967-2838

SEQ ID NO: 145195 - DNA, 4121 bp, Homo sapiens
  Payload ID: 8691
  Gene Symbol: KBTBD12
  Gene Name: kelch repeat and BTB (POZ) domain containing 12
  Uniprot ID: Q3ZCT8
  ENST ID: ENST00000343941
  CDS Start-End: 141-737
agtgtgtgtcaaaaatatatgatggaccacatggatgcctccaactgtttaggtatctattattttgcaaagcagattggagctgaagatttatctgatcgatcaaagaaatatttatatcagcactttgccgaggtatcatgatagaggaaaccagttttgggaaaagttatgcacagctgaatttcgagaactctatgctctggatggatcttcctgatgaagaacctgatcgattaagcaacaaactgttgcagtatgaccccagccaagatcaatggagtgtgcgggcacccatgaagtactctaagtaccgattcagtacagctgtagtcaacagtgagatttatgttttgggtggcattggctgtgtaggtcaagacaagggccaggttcgaaaatgccttgacgtggtggagatctacaacccagatggggacttttggcgagagggccctcccatgccaagtcccctcctctcactccgcaccaattccaccaatgcaggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcaagggcccagagacagaaagctcgtgcctgtctgcagtatcctggctgggccagattgcctggggcacagggtttgtggtcaaggctggaaaagtaggttgtagctagatgaccaacgcctgaaagaatgaggagttggacctggtctgtaagccagggaattgtctcaaaatcgtgcattaagggagacttctctctgtgctctgttccagcttcagtcttataaacactgaccattctccttcagaatccccttctactgaagcaacgccacccagcagcagggctagctgtactaccagcccctaacaaccaaggcactcaagccagaccacagtggccaagaatcctgccctgggctgactctgtccgggacagggatgtggggttctgcagcctggtccactccggggctggcagggagtgtcctggagtgggctgacccaggctgcctttgcccacctctcagacacatacaaccatctgcagggtagtcctggctgaacaggactcgcccaagccacccaagccagggacagagaaggctctggctgaggacaggggaagaagcatctcctccagctgctgccaaccccatggcccggcctttgcaataaagatggagccacccacttcagcccacaattgagcataatcagaagacagtcactcccaaaatatatgttagaaataacatttaaatgacacatgggaagtccgtctatcttacttcccgtctctaattctggaagcacagtggattcaatgagggcatcttcatagctcttcttcagcaacttctccaaagagtttcacattgcacaaggctcttttggaagcaggagtggtcagtaaattcagagggagacaaaccctaagtagagacagctttctttggtgctgagctgtgtgattgtgatgaccgctagcctgtgcccctaggttccagctgcccaccaggcaggacaggcaggtcttgccaaaactggagcctgttggaaacctatttctgccaccaaggagagggaccaggagacccagcgtaggttggccccaagtaggctcaactcgggagggtgggggtcccgcctttctcttcgcacttgtgccccaagtgcactcacagtacctggcatgtgggtgacctcttgggtggccggcatggggcagtgtttctcaatcagagggcctgggccccgagcacgtccaggaatctgagttaaagtgagcttactctttccccagtggatgatcatgatctgtgcattctttttcttgctacaaagatgttcctcctagctgctgtgttggctgtcggcggccagggttgaggacggcctccacagggcctccacttccctccattcctcttcacatagtcactccacctgctccacctgcttgaaaagtccagaaagctgccgcgtctccctggctcaaggaggccttgttggcatgtcatggcacatctcctagatgttttgggttcaagatctgggttccagcccccgctctgctacttagctaaccatgtgaacttgggcaagatgacctttctaaagcctcatttccctcatatgcagagtgggaaggaaaatattaatacatactttatagggttggtatgaggattaagtgctgagcaaagtgcctgtgaaatcctgaaataataagcatgttttagctgccattattatcatcactgtcattatcattgcagtcagcacttcccaaagcaaggtgcccaaaacagactcagtgctttagggaagtggggcagatgtgcatatggcttgtgacggttctttctttttttttttttttttgagacggagtctctctctctcgccaggctggagtgcagtgcagtggcacgatctcagcccactgcaacctccgcctcccaggttcaagtgattctcctgcctcagcctcccaagtagctgggattacaggcgcccaccaccacacccagctaatttttgtatttttagtagagacggggtttcaccatgttggccaggatggtctcaatctcttgacctcgtgatctgcccgcctcggcctcccaaagtgctgggattacaggcatgagcccctgcacctggctgagatggttcttaatttcccataccctgttgcttggctcctccagttggcggctgagagttaagcaagggtttactcggatctgaggcccccgatgccctcaatggacacattcaggaccctgtggcagctcagcagaggcacctgagggtcacgctaggtgagaccatcgcccgcctgtgggaggcaagataagtgggtaaacatcattcctgtctaatgcgaggtctgggcagtgtcccagtggaactttccagagagtgccaagggaggaccgagaaggggcatgacctctgctggagccaggagggcagtgaccaggagctggcttagcactgaagggaagcaggcatcaagggcaggatttctcaaacttcttctgaggaatccccgaggtcgaaaccggtgcttcacagatttcagatgtctgatcttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaat

SEQ ID NO: 145196 - DNA, 4302 bp, Homo sapiens
  Payload ID: 8691
  Gene Symbol: KBTBD12
  Gene Name: kelch repeat and BTB (POZ) domain containing 12
  ENST ID: ENST00000407609
  CDS Start-End: 222-914
atattgggcagtggcctcagtcaggcccgctggccgccctgccacacggtagcgtccaagccaggtcgtggcccagcgagtggggacgcgccccgaaccaggcagcaccttcgtatcatgatagaggaaaccagttttgggaaaagttatgcacagctgaatttcgagaactctatgctctgggcagtattcataatgacctttatgttataggaggacagatgaaaattaaaaaccagtatcttattacaaactgtgttgataagtactctgtagaacgggacaattggaaaagggtgtctccccttccactgcaattggcatgtcatgctgtagtgacagtgaataataaactttatgtaattggaggctggacccctcagatggatcttcctgatgaagaacctgatcgattaagcaacaaactgttgcagtatgaccccagccaagatcaatggagtgtgcgggcacccatgaagtactctaagtaccgattcagtacagctgtagtcaacagtgagatttatgttttgggtggcattggctgtgtaggtcaagacaagggccaggttcgaaaatgccttgacgtggtggagatctacaacccagatggggacttttggcgagagggccctcccatgccaagtcccctcctctcactccgcaccaattccaccaatgcaggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcaagggcccagagacagaaagctcgtgcctgtctgcagtatcctggctgggccagattgcctggggcacagggtttgtggtcaaggctggaaaagtaggttgtagctagatgaccaacgcctgaaagaatgaggagttggacctggtctgtaagccagggaattgtctcaaaatcgtgcattaagggagacttctctctgtgctctgttccagcttcagtcttataaacactgaccattctccttcagaatccccttctactgaagcaacgccacccagcagcagggctagctgtactaccagcccctaacaaccaaggcactcaagccagaccacagtggccaagaatcctgccctgggctgactctgtccgggacagggatgtggggttctgcagcctggtccactccggggctggcagggagtgtcctggagtgggctgacccaggctgcctttgcccacctctcagacacatacaaccatctgcagggtagtcctggctgaacaggactcgcccaagccacccaagccagggacagagaaggctctggctgaggacaggggaagaagcatctcctccagctgctgccaaccccatggcccggcctttgcaataaagatggagccacccacttcagcccacaattgagcataatcagaagacagtcactcccaaaatatatgttagaaataacatttaaatgacacatgggaagtccgtctatcttacttcccgtctctaattctggaagcacagtggattcaatgagggcatcttcatagctcttcttcagcaacttctccaaagagtttcacattgcacaaggctcttttggaagcaggagtggtcagtaaattcagagggagacaaaccctaagtagagacagctttctttggtgctgagctgtgtgattgtgatgaccgctagcctgtgcccctaggttccagctgcccaccaggcaggacaggcaggtcttgccaaaactggagcctgttggaaacctatttctgccaccaaggagagggaccaggagacccagcgtaggttggccccaagtaggctcaactcgggagggtgggggtcccgcctttctcttcgcacttgtgccccaagtgcactcacagtacctggcatgtgggtgacctcttgggtggccggcatggggcagtgtttctcaatcagagggcctgggccccgagcacgtccaggaatctgagttaaagtgagcttactctttccccagtggatgatcatgatctgtgcattctttttcttgctacaaagatgttcctcctagctgctgtgttggctgtcggcggccagggttgaggacggcctccacagggcctccacttccctccattcctcttcacatagtcactccacctgctccacctgcttgaaaagtccagaaagctgccgcgtctccctggctcaaggaggccttgttggcatgtcatggcacatctcctagatgttttgggttcaagatctgggttccagcccccgctctgctacttagctaaccatgtgaacttgggcaagatgacctttctaaagcctcatttccctcatatgcagagtgggaaggaaaatattaatacatactttatagggttggtatgaggattaagtgctgagcaaagtgcctgtgaaatcctgaaataataagcatgttttagctgccattattatcatcactgtcattatcattgcagtcagcacttcccaaagcaaggtgcccaaaacagactcagtgctttagggaagtggggcagatgtgcatatggcttgtgacggttctttctttttttttttttttttgagacggagtctctctctctcgccaggctggagtgcagtgcagtggcacgatctcagcccactgcaacctccgcctcccaggttcaagtgattctcctgcctcagcctcccaagtagctgggattacaggcgcccaccaccacacccagctaatttttgtatttttagtagagacggggtttcaccatgttggccaggatggtctcaatctcttgacctcgtgatctgcccgcctcggcctcccaaagtgctgggattacaggcatgagcccctgcacctggctgagatggttcttaatttcccataccctgttgcttggctcctccagttggcggctgagagttaagcaagggtttactcggatctgaggcccccgatgccctcaatggacacattcaggaccctgtggcagctcagcagaggcacctgagggtcacgctaggtgagaccatcgcccgcctgtgggaggcaagataagtgggtaaacatcattcctgtctaatgcgaggtctgggcagtgtcccagtggaactttccagagagtgccaagggaggaccgagaaggggcatgacctctgctggagccaggagggcagtgaccaggagctggcttagcactgaagggaagcaggcatcaagggcaggatttctcaaacttcttctgaggaatccccgaggtcgaaaccggtgcttcacagatttcagatgtctgatcttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaataaaa

SEQ ID NO: 145197 - DNA, 5268 bp, Homo sapiens
  Payload ID: 8691
  Gene Symbol: KBTBD12
  Gene Name: kelch repeat and BTB (POZ) domain containing 12
  Uniprot ID: Q3ZCT8
  ENST ID: ENST00000405256
  CDS Start-End: 4-1875
atcatggagtgcaagattgagggaaaagaaaaataccaacatagcttgaatttactgaataaaattcagaacatgaaagaattagcagaaatgattgatgtggtactcacagcagaaggagagaaatttccttgccacagactggtcctggctgcatttagcccttatttcaaagctatgttcacctgtggactacttgaatgtaatcaaagggaagtcatactttatgacatcacagcagaaagtgtgtcggtgttattaaattacatgtacaatgcagctttggagatcaataatgccaatgtacagactgtagctatggctgcctattttatgcagatggaagaagtcttcagtgtgtgtcaaaaatatatgatggaccacatggatgcctccaactgtttaggtatctattattttgcaaagcagattggagctgaagatttatctgatcgatcaaagaaatatttatatcagcactttgccgaggtgagcttacatgaagaaatactagaaatcgaagtgcaccaatttttgacacttattaaatcagatgatcttaacatatccagagaagagagcattctggacttagttctgagatgggtaaatcataacaaagaattgcgtacagtgcatcttgttgagcttttgaagcaagtcagattggaacttgtaaatccttcttttttaagacaagccctaagaaggaacacaatgcttctgtgtgatgcagattgtgttgacataattcaaaatgcattcaaagccatcaagacaccccaacagcactctctaaatctgcgctatggtatggagactaccagtcttctgctttgcattggcaacaattcttcaggaatcagatcaagacataggagctatggggatgccagtttttgttatgatcctgtatcacggaaaacctatttcatctcatctcccaagtacggagagggtttaggaactgtgtgtactggtgttgtcatggaaaataatactataattgtggctggagaagcaagtgcctctaaactctctagacaaaagaacaagaatgttgaaatttataggtatcatgatagaggaaaccagttttgggaaaagttatgcacagctgaatttcgagaactctatgctctgggcagtattcataatgacctttatgttataggaggacagatgaaaattaaaaaccagtatcttattacaaactgtgttgataagtactctgtagaacgggacaattggaaaagggtgtctccccttccactgcaattggcatgtcatgctgtagtgacagtgaataataaactttatgtaattggaggctggacccctcagatggatcttcctgatgaagaacctgatcgattaagcaacaaactgttgcagtatgaccccagccaagatcaatggagtgtgcgggcacccatgaagtactctaagtaccgattcagtacagctgtagtcaacagtgagatttatgttttgggtggcattggctgtgtaggtcaagacaagggccaggttcgaaaatgccttgacgtggtggagatctacaacccagatggggacttttggcgagagggccctcccatgccaagtcccctcctctcactccgcaccaattccaccaatgcaggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcaagggcccagagacagaaagctcgtgcctgtctgcagtatcctggctgggccagattgcctggggcacagggtttgtggtcaaggctggaaaagtaggttgtagctagatgaccaacgcctgaaagaatgaggagttggacctggtctgtaagccagggaattgtctcaaaatcgtgcattaagggagacttctctctgtgctctgttccagcttcagtcttataaacactgaccattctccttcagaatccccttctactgaagcaacgccacccagcagcagggctagctgtactaccagcccctaacaaccaaggcactcaagccagaccacagtggccaagaatcctgccctgggctgactctgtccgggacagggatgtggggttctgcagcctggtccactccggggctggcagggagtgtcctggagtgggctgacccaggctgcctttgcccacctctcagacacatacaaccatctgcagggtagtcctggctgaacaggactcgcccaagccacccaagccagggacagagaaggctctggctgaggacaggggaagaagcatctcctccagctgctgccaaccccatggcccggcctttgcaataaagatggagccacccacttcagcccacaattgagcataatcagaagacagtcactcccaaaatatatgttagaaataacatttaaatgacacatgggaagtccgtctatcttacttcccgtctctaattctggaagcacagtggattcaatgagggcatcttcatagctcttcttcagcaacttctccaaagagtttcacattgcacaaggctcttttggaagcaggagtggtcagtaaattcagagggagacaaaccctaagtagagacagctttctttggtgctgagctgtgtgattgtgatgaccgctagcctgtgcccctaggttccagctgcccaccaggcaggacaggcaggtcttgccaaaactggagcctgttggaaacctatttctgccaccaaggagagggaccaggagacccagcgtaggttggccccaagtaggctcaactcgggagggtgggggtcccgcctttctcttcgcacttgtgccccaagtgcactcacagtacctggcatgtgggtgacctcttgggtggccggcatggggcagtgtttctcaatcagagggcctgggccccgagcacgtccaggaatctgagttaaagtgagcttactctttccccagtggatgatcatgatctgtgcattctttttcttgctacaaagatgttcctcctagctgctgtgttggctgtcggcggccagggttgaggacggcctccacagggcctccacttccctccattcctcttcacatagtcactccacctgctccacctgcttgaaaagtccagaaagctgccgcgtctccctggctcaaggaggccttgttggcatgtcatggcacatctcctagatgttttgggttcaagatctgggttccagcccccgctctgctacttagctaaccatgtgaacttgggcaagatgacctttctaaagcctcatttccctcatatgcagagtgggaaggaaaatattaatacatactttatagggttggtatgaggattaagtgctgagcaaagtgcctgtgaaatcctgaaataataagcatgttttagctgccattattatcatcactgtcattatcattgcagtcagcacttcccaaagcaaggtgcccaaaacagactcagtgctttagggaagtggggcagatgtgcatatggcttgtgacggttctttctttttttttttttttttgagacggagtctctctctctcgccaggctggagtgcagtgcagtggcacgatctcagcccactgcaacctccgcctcccaggttcaagtgattctcctgcctcagcctcccaagtagctgggattacaggcgcccaccaccacacccagctaatttttgtatttttagtagagacggggtttcaccatgttggccaggatggtctcaatctcttgacctcgtgatctgcccgcctcggcctcccaaagtgctgggattacaggcatgagcccctgcacctggctgagatggttcttaatttcccataccctgttgcttggctcctccagttggcggctgagagttaagcaagggtttactcggatctgaggcccccgatgccctcaatggacacattcaggaccctgtggcagctcagcagaggcacctgagggtcacgctaggtgagaccatcgcccgcctgtgggaggcaagataagtgggtaaacatcattcctgtctaatgcgaggtctgggcagtgtcccagtggaactttccagagagtgccaagggaggaccgagaaggggcatgacctctgctggagccaggagggcagtgaccaggagctggcttagcactgaagggaagcaggcatcaagggcaggatttctcaaacttcttctgaggaatccccgaggtcgaaaccggtgcttcacagatttcagatgtctgatcttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaataaaagatca

SEQ ID NO: 145198 - DNA, 5727 bp, Homo sapiens
  Payload ID: 8691
  Gene Symbol: KBTBD12
  Gene Name: kelch repeat and BTB (POZ) domain containing 12
  Uniprot ID: Q3ZCT8
  ENST ID: ENST00000405109
  CDS Start-End: 468-2339
agtagggtacgggacgcgcgcggggagaccctgtgcagcgacaccggggctgtagtcgccgtctggaaccagcgcgggaataggtgcgcaggcgcacagtggctggagggcagcggcggcgtggtctcgggccacttccaagcagagggcagcacctgtcccctcggaggcgctgccagcgccctccctcctcctccgcagggcgcgggacctctatttatatcgcccagccagcacaggcccatattgggcagtggcctcagtcaggcccgctggccgccctgccacacggtagcgtccaagccaggtcgtggcccagcgagtggggacgcgccccgaaccaggcagcaccttcaaatgtttcctgacatctttgtagcttcatgagtaatcagacatgcaaatagcccctcaggaatcaagctacacttaaagaagacttagttggaaactttggagagtagatcatggagtgcaagattgagggaaaagaaaaataccaacatagcttgaatttactgaataaaattcagaacatgaaagaattagcagaaatgattgatgtggtactcacagcagaaggagagaaatttccttgccacagactggtcctggctgcatttagcccttatttcaaagctatgttcacctgtggactacttgaatgtaatcaaagggaagtcatactttatgacatcacagcagaaagtgtgtcggtgttattaaattacatgtacaatgcagctttggagatcaataatgccaatgtacagactgtagctatggctgcctattttatgcagatggaagaagtcttcagtgtgtgtcaaaaatatatgatggaccacatggatgcctccaactgtttaggtatctattattttgcaaagcagattggagctgaagatttatctgatcgatcaaagaaatatttatatcagcactttgccgaggtgagcttacatgaagaaatactagaaatcgaagtgcaccaatttttgacacttattaaatcagatgatcttaacatatccagagaagagagcattctggacttagttctgagatgggtaaatcataacaaagaattgcgtacagtgcatcttgttgagcttttgaagcaagtcagattggaacttgtaaatccttcttttttaagacaagccctaagaaggaacacaatgcttctgtgtgatgcagattgtgttgacataattcaaaatgcattcaaagccatcaagacaccccaacagcactctctaaatctgcgctatggtatggagactaccagtcttctgctttgcattggcaacaattcttcaggaatcagatcaagacataggagctatggggatgccagtttttgttatgatcctgtatcacggaaaacctatttcatctcatctcccaagtacggagagggtttaggaactgtgtgtactggtgttgtcatggaaaataatactataattgtggctggagaagcaagtgcctctaaactctctagacaaaagaacaagaatgttgaaatttataggtatcatgatagaggaaaccagttttgggaaaagttatgcacagctgaatttcgagaactctatgctctgggcagtattcataatgacctttatgttataggaggacagatgaaaattaaaaaccagtatcttattacaaactgtgttgataagtactctgtagaacgggacaattggaaaagggtgtctccccttccactgcaattggcatgtcatgctgtagtgacagtgaataataaactttatgtaattggaggctggacccctcagatggatcttcctgatgaagaacctgatcgattaagcaacaaactgttgcagtatgaccccagccaagatcaatggagtgtgcgggcacccatgaagtactctaagtaccgattcagtacagctgtagtcaacagtgagatttatgttttgggtggcattggctgtgtaggtcaagacaagggccaggttcgaaaatgccttgacgtggtggagatctacaacccagatggggacttttggcgagagggccctcccatgccaagtcccctcctctcactccgcaccaattccaccaatgcaggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcaagggcccagagacagaaagctcgtgcctgtctgcagtatcctggctgggccagattgcctggggcacagggtttgtggtcaaggctggaaaagtaggttgtagctagatgaccaacgcctgaaagaatgaggagttggacctggtctgtaagccagggaattgtctcaaaatcgtgcattaagggagacttctctctgtgctctgttccagcttcagtcttataaacactgaccattctccttcagaatccccttctactgaagcaacgccacccagcagcagggctagctgtactaccagcccctaacaaccaaggcactcaagccagaccacagtggccaagaatcctgccctgggctgactctgtccgggacagggatgtggggttctgcagcctggtccactccggggctggcagggagtgtcctggagtgggctgacccaggctgcctttgcccacctctcagacacatacaaccatctgcagggtagtcctggctgaacaggactcgcccaagccacccaagccagggacagagaaggctctggctgaggacaggggaagaagcatctcctccagctgctgccaaccccatggcccggcctttgcaataaagatggagccacccacttcagcccacaattgagcataatcagaagacagtcactcccaaaatatatgttagaaataacatttaaatgacacatgggaagtccgtctatcttacttcccgtctctaattctggaagcacagtggattcaatgagggcatcttcatagctcttcttcagcaacttctccaaagagtttcacattgcacaaggctcttttggaagcaggagtggtcagtaaattcagagggagacaaaccctaagtagagacagctttctttggtgctgagctgtgtgattgtgatgaccgctagcctgtgcccctaggttccagctgcccaccaggcaggacaggcaggtcttgccaaaactggagcctgttggaaacctatttctgccaccaaggagagggaccaggagacccagcgtaggttggccccaagtaggctcaactcgggagggtgggggtcccgcctttctcttcgcacttgtgccccaagtgcactcacagtacctggcatgtgggtgacctcttgggtggccggcatggggcagtgtttctcaatcagagggcctgggccccgagcacgtccaggaatctgagttaaagtgagcttactctttccccagtggatgatcatgatctgtgcattctttttcttgctacaaagatgttcctcctagctgctgtgttggctgtcggcggccagggttgaggacggcctccacagggcctccacttccctccattcctcttcacatagtcactccacctgctccacctgcttgaaaagtccagaaagctgccgcgtctccctggctcaaggaggccttgttggcatgtcatggcacatctcctagatgttttgggttcaagatctgggttccagcccccgctctgctacttagctaaccatgtgaacttgggcaagatgacctttctaaagcctcatttccctcatatgcagagtgggaaggaaaatattaatacatactttatagggttggtatgaggattaagtgctgagcaaagtgcctgtgaaatcctgaaataataagcatgttttagctgccattattatcatcactgtcattatcattgcagtcagcacttcccaaagcaaggtgcccaaaacagactcagtgctttagggaagtggggcagatgtgcatatggcttgtgacggttctttctttttttttttttttttgagacggagtctctctctctcgccaggctggagtgcagtgcagtggcacgatctcagcccactgcaacctccgcctcccaggttcaagtgattctcctgcctcagcctcccaagtagctgggattacaggcgcccaccaccacacccagctaatttttgtatttttagtagagacggggtttcaccatgttggccaggatggtctcaatctcttgacctcgtgatctgcccgcctcggcctcccaaagtgctgggattacaggcatgagcccctgcacctggctgagatggttcttaatttcccataccctgttgcttggctcctccagttggcggctgagagttaagcaagggtttactcggatctgaggcccccgatgccctcaatggacacattcaggaccctgtggcagctcagcagaggcacctgagggtcacgctaggtgagaccatcgcccgcctgtgggaggcaagataagtgggtaaacatcattcctgtctaatgcgaggtctgggcagtgtcccagtggaactttccagagagtgccaagggaggaccgagaaggggcatgacctctgctggagccaggagggcagtgaccaggagctggcttagcactgaagggaagcaggcatcaagggcaggatttctcaaacttcttctgaggaatccccgaggtcgaaaccggtgcttcacagatttcagatgtctgatcttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaataaaa

SEQ ID NO: 145199 - DNA, 1377 bp, Homo sapiens
  Payload ID: 8692
  Gene Symbol: KBTBD13
  Gene Name: kelch repeat and BTB (POZ) domain containing 13
  Uniprot ID: C9JR72
  ENST ID: ENST00000432196
  CDS Start-End: 1-1377
atggcacggggtccacagaccctggtgcaggtgtgggtgggcggccagctcttccaagccgaccgcgccctgctggtggagcactgtggcttcttccgaggcctcttccgctccggcatgcgggagacccgcgcagcagaggtgcgcctgggcgttctgagcgcgggaggtttccgcgccacgctgcaggtgctgcgcggcgaccggccggcgctggcggcggaggacgagctgctgcaggccgtggagtgcgccgccttcctccaggcgccggcgctggctcgctttctggagcacaacctcacgtcggacaactgcgcattgctgtgcgacgcggccgccgccttcggcctgcgcgacgtgttccacagtgccgcgctcttcatctgcgacggcgagcgcgagctggcggccgaactggcgctgcctgaggcccgcgcctacgtggcggccctgcggcccagcagctacgcggccgtgagcacgcacacgcccgcgcccggcttcctggaggacgcctcgcgcacgctgtgttacctggacgaggaagaggacgcgtggcgcacgctggctgcgctgcccctggaggccagcacgttgctggccggggtggccacgctgggcaacaagctttacatcgtggggggcgtgcgcggcgccagcaaggaggtggtagagctgggcttctgctacgaccccgacggcggcacgtggcacgagttccccagcccgcaccagccgcgctatgacacagcgctggccggcttcgacggccgcctctacgccatcggcggcgaattccagaggacgcccatcagctccgtggagcgctacgacccagccgcgggctgctggagtttcgtggccgacctgccgcagccggccgccggcgtgccctgcgcccaggcttgtggccgtctcttcgtgtgcctgtggcggccggccgacaccaccgccgtggtggagtacgcagtgcggaccgacgcgtggctgccagtggccgagctgcggcgtccgcagagctatggccactgcatggtggcccaccgcgacagcctctatgtggtgcgcaacggaccttccgacgacttcctgcactgcgccatcgactgtctcaacctggccacgggccagtggacggcgctgcccggccagttcgtcaacagcaagggagcgctcttcacggccgtggtgcgcggtgacaccgtctatacggtcaaccgcatgttcacgctgctctacgccatcgagggcggcacctggcggctgctcagggagaaagccggcttcccgcggcccggctccttgcagacctttctcctaaggctgcctcctggcgctcctgggcctgtgacttcgacaacggcagaactgtga

SEQ ID NO: 145200 - DNA, 3745 bp, Homo sapiens
  Payload ID: 8693
  Gene Symbol: KBTBD2
  Gene Name: kelch repeat and BTB (POZ) domain containing 2
  Uniprot ID: Q8IY47
  ENST ID: ENST00000304056
  CDS Start-End: 701-2572
gcgggggcggcgggggcggcgggcccggcgtctcgcggccccggactgacaaggcggcgcgggcgggcgggcggcgcggctcccgggggaggagtctggcggtggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctaggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtggggcgccgccaatctaacatgagcacaggtgcttcatgacaaacattactagcatgttcaactgcaccatgttctggcactgtattttgaatgacattaatttattaaataaattgtatatattcaa

SEQ ID NO: 145201 - DNA, 593 bp, Homo sapiens
  Payload ID: 8693
  Gene Symbol: KBTBD2
  Gene Name: kelch repeat and BTB (POZ) domain containing 2
  ENST ID: ENST00000424468
  CDS Start-End: 581-593
gcattgcagcacacaacggaaggcttcagacgctggagctgccgtccgcacccagatgtctctctctcccttttcccctaacctcccccaactgcgggcccttttgggtgctgctctgacttcttccttggccttgggaaaagccgaagcggctctggagagaggagggcatggtttggagaagaggtgctgcggcaacaaagcgacccgcccaacgcctcctcaactttctcctgcccccgttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaag

SEQ ID NO: 145202 - DNA, 537 bp, Homo sapiens
  Payload ID: 8693
  Gene Symbol: KBTBD2
  Gene Name: kelch repeat and BTB (POZ) domain containing 2
  ENST ID: ENST00000452926
  CDS Start-End: 395-537
aattgttttggctttccggtggcatccggcagaggaaaagggcgggggcagctagattactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggt

SEQ ID NO: 145203 - DNA, 724 bp, Homo sapiens
  Payload ID: 8693
  Gene Symbol: KBTBD2
  Gene Name: kelch repeat and BTB (POZ) domain containing 2
  ENST ID: ENST00000453627
  CDS Start-End: 636-724
attcccagtgtttttctcttttgtaatctttataggtggccaaattacaattctagacaatgagatgtttgtggaagtctgctgagtttgggagatgtagtatcctgagaaagctttcactttcctgaagaaaaaaaagaccatggatggtggaagccaccccctttcccctcttcttgccttgaacaaaggtgcgaaggctaaaactgctgcagccatattgcaaccatgaagtcaatgtcgagagaatcacagaaatgatggccctgctgttcttgagctattgaaccaacaaagttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtt

SEQ ID NO: 145204 - DNA, 556 bp, Homo sapiens
  Payload ID: 8693
  Gene Symbol: KBTBD2
  Gene Name: kelch repeat and BTB (POZ) domain containing 2
  ENST ID: ENST00000423022
  CDS Start-End: 516-556
aaagactcgcgacgtgttcgcgacatggtgggccgaaggaggacacccccttccttctgtattccccccgcgtacatctgaactaaccaagagaggtctagacgaacagagctcctgttatggtctatatcgacttaaaaaagaaagcagaaactgccctttgaaacggaaaattgtttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgc

SEQ ID NO: 145205 - DNA, 1196 bp, Homo sapiens
  Payload ID: 8693
  Gene Symbol: KBTBD2
  Gene Name: kelch repeat and BTB (POZ) domain containing 2
  ENST ID: ENST00000621876
  CDS Start-End: 69-1073
cacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttg

SEQ ID NO: 145206 - DNA, 3396 bp, Homo sapiens
  Payload ID: 8694
  Gene Symbol: KBTBD3
  Gene Name: kelch repeat and BTB (POZ) domain containing 3
  ENST ID: ENST00000534815
  CDS Start-End: 43-1644
ggagactggggtggagacttcggagactgcagttgcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccagacacttgtgtttggaaaggcgaaggatcttttgagtgtgcaggctttaatgcaggtgcaattggaattgaagataaaatttatatattaggtggtgattatgcaccagatgaaatcacagatgaagtgcaggtctaccacagcaacaggtctgaatgggaagaagtttcaccaatgcctagagccttaacagaattttactgccaggtgattcagtttaataaatacagagacccatggttttctaatctatgtgcttgaacattctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttaccaaaaattatactgaatataatttaaccttggggaatccagaatacttagtattttcacatgaaactacaaatcatagactctgacactttgatttttaaagtactctgtccataaaagatttgtactgtttagatgggagaaacctctagagagagtaaaaatgaattacactgtatcttatatgaagtaaaaaataaatcagaggtgagaatattgttactgcgggtatgagttgttgaattcctatcatttgtgatgattggttaacttcttttaggtaccctttttacccttttttagttcagaaataattctcccagctttataaatagtacactaaacatagtttaactttttttaatgactcattttttcattaaaagcataatgtaccatgttataatgccattagcagttacttaaatgctttaaaaattgctgattagttttcaatgtcagttggtttcaatttctagctctctctctctctctcctccccccctctcattttctggttcaatcttagtaaattaacattctggatttaattagtagttctaagttacacctggcctgagtttatgttaacatgtaaccctcaattggaaatttttggattctgggatggcagtactaaaatactttttatgtatcattgctaggttccagcctaattaaggacatagaaaattgacctctaattaagtggatcattattatggcatttcttaagctttatccaaatttcagctacataaaacatttcaggatttaaattagtaccatatcaattttctgtgatgatgtataccaactataaagcactatgttggtttactacttcagtaaattattcttagtgaattattttctaaattaaaaaaaatgacttggcttttggtattgataatagtattcacaacctgcatctgttaagatgtttgatctttaacccacacaatgtaagggtactgttgtcattgttctcaggtaggtgattctgccttccaagagtatatgtttctttaatcagtttaaaagataaaggcattttgggttttaagacccctgctttacatctcaggtaatgtgtagattgtacttctctggaaccaaatgtagttttctacactcagttgtaaatgttaatctttctcaaatgtgcacattctttaaaagtgtgttcctaagtagaaatacacctaaatgaagattctcttattttatcatataaatttatgcaacgataagttccaaatgtatttttcaaaacagaatggaatatcagagtacattttcatgaagtttaaaaatcaaggactgttcctgattagatgacgtatttattggtggccttcttatctaagcacatgagtagttggctctgaactttgtgtatttgaaaaaggaaaattcagtggaggcttttgtttgtgtgtgtgtggctttgaaaacaaattatttgagaaagaccataacacagtgagtagcctatatgtgcatttactgaattgttaatttaaggatatatattaatagagtatgtttaaaataaatattgttttcatcactga

SEQ ID NO: 145207 - DNA, 2682 bp, Homo sapiens
  Payload ID: 8694
  Gene Symbol: KBTBD3
  Gene Name: kelch repeat and BTB (POZ) domain containing 3
  Uniprot ID: Q8NAB2
  ENST ID: ENST00000531837
  CDS Start-End: 668-2506
agcgcacgccctccatggatggcaccaagcagaaccgtttggcagggaaaaccatacactgaaagcggacctcgccgctatctcgggcctgatggcgcggacgcaaacgtggccccacccccttcttcccggcgtccgtgcgcaggggacgggccgtcgctacgcagactggcccaccgacagccctcccagcccgcccccgactcagccacctcctctcggagaaagcagctgggggcggagacggagatcagccctgcgctttgcggcattgtatgacgtcaagtaggcgaggcttcggaggcgagcgaagggcgggaccaaggccaagagcccgacagttacgccactcacacttgcggaagagttaacgggacagcggtgcaggccaatcgcaaccagtcctctggaggcagggagactggggtggagacttcggagactgcagttgcagttgttccgtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcgttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccagacacttgtgtttggaaaggcgaaggatcttttgagtgtgcaggctttaatgcaggtgcaattggaattgaagataaaatttatatattaggtggtgattatgcaccagatgaaatcacagatgaagtgcaggtctaccacagcaacaggtctgaatgggaagaagtttcaccaatgcctagagccttaacagaattttactgccaggtgattcagtttaataaatacagagacccatggttttctaatctatgtgcttgaacattctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttac

SEQ ID NO: 145208 - DNA, 297 bp, Homo sapiens
  Payload ID: 8694
  Gene Symbol: KBTBD3
  Gene Name: kelch repeat and BTB (POZ) domain containing 3
  ENST ID: ENST00000532662
  CDS Start-End: 199-297
gtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcgggctatgtttgaagtaaacatgaaagaaagagatgatggaagtgttaccattactaatttgtcctccaaggcagtaaaagcatttctcgattatgcctatact

SEQ ID NO: 145209 - DNA, 3751 bp, Homo sapiens
  Payload ID: 8694
  Gene Symbol: KBTBD3
  Gene Name: kelch repeat and BTB (POZ) domain containing 3
  Uniprot ID: Q8NAB2
  ENST ID: ENST00000526793
  CDS Start-End: 161-1999
agcgaagggcgggaccaaggccaagagcccgacagttacgccactcacacttgcggaagagttaacgggacagcggtgcaggccaatcgcaaccagtcctctggaggcagggagactggggtggagacttcggagactgcagttgcagttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccagacacttgtgtttggaaaggcgaaggatcttttgagtgtgcaggctttaatgcaggtgcaattggaattgaagataaaatttatatattaggtggtgattatgcaccagatgaaatcacagatgaagtgcaggtctaccacagcaacaggtctgaatgggaagaagtttcaccaatgcctagagccttaacagaattttactgccaggtgattcagtttaataaatacagagacccatggttttctaatctatgtgcttgaacattctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttaccaaaaattatactgaatataatttaaccttggggaatccagaatacttagtattttcacatgaaactacaaatcatagactctgacactttgatttttaaagtactctgtccataaaagatttgtactgtttagatgggagaaacctctagagagagtaaaaatgaattacactgtatcttatatgaagtaaaaaataaatcagaggtgagaatattgttactgcgggtatgagttgttgaattcctatcatttgtgatgattggttaacttcttttaggtaccctttttacccttttttagttcagaaataattctcccagctttataaatagtacactaaacatagtttaactttttttaatgactcattttttcattaaaagcataatgtaccatgttataatgccattagcagttacttaaatgctttaaaaattgctgattagttttcaatgtcagttggtttcaatttctagctctctctctctctctcctccccccctctcattttctggttcaatcttagtaaattaacattctggatttaattagtagttctaagttacacctggcctgagtttatgttaacatgtaaccctcaattggaaatttttggattctgggatggcagtactaaaatactttttatgtatcattgctaggttccagcctaattaaggacatagaaaattgacctctaattaagtggatcattattatggcatttcttaagctttatccaaatttcagctacataaaacatttcaggatttaaattagtaccatatcaattttctgtgatgatgtataccaactataaagcactatgttggtttactacttcagtaaattattcttagtgaattattttctaaattaaaaaaaatgacttggcttttggtattgataatagtattcacaacctgcatctgttaagatgtttgatctttaacccacacaatgtaagggtactgttgtcattgttctcaggtaggtgattctgccttccaagagtatatgtttctttaatcagtttaaaagataaaggcattttgggttttaagacccctgctttacatctcaggtaatgtgtagattgtacttctctggaaccaaatgtagttttctacactcagttgtaaatgttaatctttctcaaatgtgcacattctttaaaagtgtgttcctaagtagaaatacacctaaatgaagattctcttattttatcatataaatttatgcaacgataagttccaaatgtatttttcaaaacagaatggaatatcagagtacattttcatgaagtttaaaaatcaaggactgttcctgattagatgacgtatttattggtggccttcttatctaagcacatgagtagttggctctgaactttgtgtatttgaaaaaggaaaattcagtggaggcttttgtttgtgtgtgtgtggctttgaaaacaaattatttgagaaagaccataacacagtgagtagcctatatgtgcatttactgaattgttaatttaaggatatatattaatagagtatgtttaaaataaatattgttttcatcactga

SEQ ID NO: 145210 - DNA, 874 bp, Homo sapiens
  Payload ID: 8694
  Gene Symbol: KBTBD3
  Gene Name: kelch repeat and BTB (POZ) domain containing 3
  ENST ID: ENST00000531482
  CDS Start-End: 15-290
agttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcaggtcttcccaggtcagcatttcccaaagttctctggaacattaatcccttgaactacgctgggacagaagaaatttttttgatggtgtcagctttgtttgggggatccctgtgttgtattattttagaaaaagaagacgacaggttgaacaaaaatggaagcaaaatttgaagaaaataactctgcgagaaaagaaaatttccgtcctgtgttgtattcatgtattacggggagaggagggtctaaccgatttaaaaatttatcctctccttagcaaattcatcctctccttatattagggaaaagtacttcttagctataaggcatttcttgaaagctctcagcttgttctaattctaagcaaccttctgaatataatttggtttcccatgtagatcaccctaaagagaatgtcctattcataacactgcagtaatcactatgatgacagcagatttccatttctgcgaagttaagggtcagacacatgaccttgcaattactgtgttaattgtatcaaggtagtactatcctgtgaggcttcttggtcaatagacaagccccttttggtgaaaccctgatcttcagccttcctagttatactacaataaacttaaatcctaattgc

SEQ ID NO: 145211 - DNA, 2460 bp, Homo sapiens
  Payload ID: 8695
  Gene Symbol: KBTBD4
  Gene Name: kelch repeat and BTB (POZ) domain containing 4
  Uniprot ID: Q9NVX7
  ENST ID: ENST00000395288
  CDS Start-End: 172-1728
gaggttccgggctccgggatgaaaggagggaacgcaggtgagaaagcgagacaggcaggtagggaaatcgtgaggtgagcgtggtcctagctccttgtggcagagcctagagagaaggcgaggacgctgaagaaccaggcggacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttatccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggg

SEQ ID NO: 145212 - DNA, 2372 bp, Homo sapiens
  Payload ID: 8695
  Gene Symbol: KBTBD4
  Gene Name: kelch repeat and BTB (POZ) domain containing 4
  Uniprot ID: Q9NVX7
  ENST ID: ENST00000430070
  CDS Start-End: 65-1669
aagtgtgcagcagatcttcttccgggcggacgtggagccggaagcggaggttccgggctccgggatgaaaggagggaacgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttatccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaac

SEQ ID NO: 145213 - DNA, 546 bp, Homo sapiens
  Payload ID: 8695
  Gene Symbol: KBTBD4
  Gene Name: kelch repeat and BTB (POZ) domain containing 4
  ENST ID: ENST00000534239
  CDS Start-End: 26-546
ggaagcggaggttccgggctccgggatgaaaggagggaacgcaggttactcaagatggtgttgctttgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttca

SEQ ID NO: 145214 - DNA, 2444 bp, Homo sapiens
  Payload ID: 8695
  Gene Symbol: KBTBD4
  Gene Name: kelch repeat and BTB (POZ) domain containing 4
  Uniprot ID: Q9NVX7
  ENST ID: ENST00000526005
  CDS Start-End: 155-1711
ccgggatgaaaggagggaacgcaggtgagaaagcgagacaggcaggtagggaaatcgtgaggtgagcgtggtcctagctccttgtggcagagcctagagagaaggcgaggacgctgaagaaccaggcggctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttatccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggga

SEQ ID NO: 145215 - DNA, 764 bp, Homo sapiens
  Payload ID: 8695
  Gene Symbol: KBTBD4
  Gene Name: kelch repeat and BTB (POZ) domain containing 4
  ENST ID: ENST00000529499
  CDS Start-End: 169-764
aacgcaggtgagaaagcgagacaggcaggtagggaaatcgtgaggtgagcgtggtcctagctccttgtggcagagcctagagagaaggcgaggacgctgaagaaccaggcgggttactcaagatggtgttgctttgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcgggtaagtt

SEQ ID NO: 145216 - DNA, 596 bp, Homo sapiens
  Payload ID: 8695
  Gene Symbol: KBTBD4
  Gene Name: kelch repeat and BTB (POZ) domain containing 4
  ENST ID: ENST00000531067
  CDS Start-End: 114-596
ctctgagccaagcttttgacgagggcgggcgggcctgagcgggaagaacggtttccctggcgaccgtttccaagacgactcaagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgag

SEQ ID NO: 145217 - DNA, 980 bp, Homo sapiens
  Payload ID: 8695
  Gene Symbol: KBTBD4
  Gene Name: kelch repeat and BTB (POZ) domain containing 4
  ENST ID: ENST00000525720
  CDS Start-End: 111-971
ctctgagccaagcttttgacgagggcgggcgggcctgagcgggaagaacggtttccctggcgaccgtttccaagacgactcaaggtggagcggggacattgcacagggtgatgggcctcccagtgccccggcctgggggcggatggactcaagttctgggacgcagccatagggagtctttcgagcgagcggggaagtgtgggggaagcagctcagaagagagcaaatacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggtaaggcaaatctcttaattgttgaga

SEQ ID NO: 145218 - DNA, 542 bp, Homo sapiens
  Payload ID: 8695
  Gene Symbol: KBTBD4
  Gene Name: kelch repeat and BTB (POZ) domain containing 4
  ENST ID: ENST00000529946
  CDS Start-End: 66-542
aaggagggaacgcaggtgagaaagcgagacaggcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgat

SEQ ID NO: 145219 - DNA, 776 bp, Homo sapiens
  Payload ID: 8695
  Gene Symbol: KBTBD4
  Gene Name: kelch repeat and BTB (POZ) domain containing 4
  ENST ID: ENST00000530668
  CDS Start-End: 23-118
agcggaggttccgggctccgggatgaaaggagggaacgcagactatggctgtgaattcctcaggttactcaagatggtgttgctttgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaa

SEQ ID NO: 145220 - DNA, 3079 bp, Homo sapiens
  Payload ID: 8695
  Gene Symbol: KBTBD4
  Gene Name: kelch repeat and BTB (POZ) domain containing 4
  ENST ID: ENST00000533290
  CDS Start-End: 716-2347
gctacacacccctcccccgctctctgagccaagcttttgacgagggcgggcgggcctgagcgggaagaacggtttccctggcgaccgtttccaagacgactcaaggtggagcggggacattgcacagggtgatgggcctcccagtgccccggcctgggggcggatggactcaagttctgggacgcagccatagggagtctttcgagcgagcggggaagtgtgggggaagcagctcagaagagagcaaatgtaagacccacggatatcccaggctaggcttcatatggagcgtcttaactccatgcgctgggaaggagaggacctggccactaggccggggccaggggtcctttttgtctgattctactgcccctgagcttcactagttttatgccccagttatttggttagtaaggcttttacgatcacaggcctctcccagccctttgctttcatatattgacctaaatcccaagtcttttgttaacattatggaaaggaattattccgtgttttctcaggaaaacacccagagttggaacttttatttatatcattagcggaggggcgccactggggataacgaacccagatttggttaaaggatagcgtcagggacatcatggacagggccaggactaaggccaatctggacccactttgctctcacttcttccttttccctccctgagttggacagttggattcacagactatggctgtgaattcctcaggttactcaagatggtgttgctttgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttatccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggg

SEQ ID NO: 145221 - DNA, 5178 bp, Homo sapiens
  Payload ID: 8696
  Gene Symbol: KBTBD6
  Gene Name: kelch repeat and BTB (POZ) domain containing 6
  Uniprot ID: Q86V97
  ENST ID: ENST00000379485
  CDS Start-End: 236-2260
gtgaaggcgagcagacgcggagaaaggacgcgggagtgagagagggtgagtcagccactgtctaaacgataacgggaggcggttctgcggggtagggttgaattcagtaaatgggctcgtgctgctgtctcttcggagacgctgctatcttagcgtcagcgagggaaggttgaggaggagccagagccgggtcctgcagcgtttctcgccatcagcgcccgtcgccatctccaccatgcagtcccgggaagacgccccgcgctctcgccgcctagccagtccccgtggtgggaagcggcccaagaagattcacaaacccacagtttcggcctttttcacgggtccagaggaattaaaggacacggcccattctgcagccctgctggcacagctcaagtccttctacgatgcgcggctgctgtgtgatgtgaccatcgaggtggtgacgcctggcagcgggcctggcacgggtcgcctgttcccctgcaaccgcaatgtgctggccgcggcatgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgatccatactcgggggacctttacaaagtgccgtcacctttgacctgtctggctcacactaggactgtcaccactttagctgtctgtatctctcctgaccatgacatctatctagctgctcagcccaggacagacctctgggtgtataaaccagctcagaatagttggcagcaacttgcagatcgcttgctgtgtcgtgagggcatggatgtggcatatctcaatggctatatctacattttgggggggcgagaccctattactggagttaagttgaaggaagtggaatgctacaatgttaagagaaaccagtgggcattggtggctccactgccccattcttttttatcctttgacctaatggtaattcgagactatctctatgctctcaacagtaagcgcatgttctgttatgatcctagccacaatatgtggctgaagtgcgtttctctgaagcgcaatgactttcaggaagcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccagtatttatttgattatttagtatgtttatgtttcatgacactaatttagtcttttgatacattttacattctgtttactgccacaagcactgtggcaataacttttgaattttaatttttataatagaaaaatgattaggaattgctagatagtgttttgaaagcatatctttttcttcagaacaatgtagacttccaaaatggttaacctaaggggtctttacaaaatgtgttataagttaaacataatttgggaagttttacttttgttttcttctatgaagaaaaaaatgcaggctgggcgcggtggctcacgcctgtaatcctagcactttgggaggccgaggcaggtggatcacctgaggtcagttcaagaccagcctggccaacatggtgaaaccccgtctctactaaaaatacaaaaattagctgggcgtggtggcatgcgcctgtaatcccagctacccaggaggctgaggcaggagaattgctgaaacccgggagtcagaggctgcagagagccgagactgggccactgcactccagcctggatgacagagtgagactccgtctcaaaaaaaaaaaaaaaaaaaaaaggaaaaaaaaaaaagaaaaaaaaccatatgtgtattagggtgactgagtggtgacttcatttataataatacagagaatagctataagctcattgacagtaaaaacaacaaaccaggattctactgtttgaaaagaagtttcgttttaattttggaatttagaatgtgtatttgcaaagtcaccaattttcatctaaaaggttatattctagttgtgtcaccaaatcatcaaaaaaccttaaaaaagaagtaacttgctttgtaggtttgtattgttgatctaaacctgatacatgcttcatttaatcaggaataatccttttttttctgctggacatgtataaatttcactggattgtataaatttttatctattgccttaaacatttacatgattctcaatatgttttagctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtatgtggttaattataaataaaactggtaccagaa

SEQ ID NO: 145222 - DNA, 4734 bp, Homo sapiens
  Payload ID: 8697
  Gene Symbol: KBTBD7
  Gene Name: kelch repeat and BTB (POZ) domain containing 7
  Uniprot ID: Q8WVZ9
  ENST ID: ENST00000379483
  CDS Start-End: 310-2364
agttctcccgggcgcctagcgggatcgccagcgcggcagtgggggcttccgcggctgcaagccagcgggtcctgtgagggcgagcggaggcggagaaagggcgcgggagtgagagagggtgagtcagccactgtctatgcaataaagggaggcctcaccgcgggatagggctgaattcagaagtgcggcccgtgccgcagtctgttccaggacgcggcttgtcttagcgtcagcgagggaaggttgaggaggagccagagcctggtcctgcagcctttctcgccgtcagcgcccgtcgccatctccaccatgcagtcccgggaagacgtcccgcgctctcgccgcctcgccagtccccgtggtgggaggcggcccaagaggatttccaagccctcggtttcggcctttttcacgggtccagaggagttaaaggacacggcccattctgcagccctgctggcacagctcaagtccttctacgacgcgcggctgctgtgtgatgtgaccatcgaggtggtgacgcctggcagcgggcctggcacgggtcgcctcttttcctgcaatcgcaacgtgctagcagctgcgtgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaatgtgcagcgcctgtacgcggcctccgacatgctacagctggaatatgtgcgggaagcctgtgcctccttcttagcccgacgtcttgacctgaccaactgcaccgccatcctcaagtttgcagacgccttcgaccatcacaagcttcgatctcaggcccagtcctacatagctcacaacttcaagcagctcagccgaatgggttcaattcgggaggagactctagcagatctaaccctggcccagctgctggctgtcctacgcctggatagtctggacatagagagtgagcggactgtatgccatgtagctgtgcagtggctggaggctgctgccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacatcctagagatccctttctctgctatgacccttactcgggggacatttacacaatgccatcccctttgaccagctttgctcacactaagactgtcacctcctcagctgtctgtgtgtccccagaccatgacatctatctagctgctcagcccaggaaagacctctgggtgtataaaccagctcagaatagttggcagcaacttgcagatcgcttgctgtgtcgtgagggcatggatgtggcatatctcaatggctacatctacattttggggggacgagaccctattactggagttaagttgaaggaagtggaatgctacagtgttcagagaaaccagtgggcattggtggctcctgtccctcattccttctattcctttgaactcatagtggttcagaactatctttatgctgtcaacagtaagcgcatgctttgctatgatcctagccacaatatgtggctgaactgtgcttctcttaaacgtagtgactttcaggaagcatgtgtcttcaatgatgaaatctattgtatctgtgacatcccagtcatgaaggtctacaacccagctaggggagaatggaggcggattagtaatattcctttggattcagagacccacaactaccagattgtcaatcatgaccaaaagttgcttctcatcacttctacaaccccacaatggaaaaagaaccgagtgacagtgtatgagtatgatactagggaagatcagtggattaatataggtaccatgttaggccttttgcagtttgactctggctttatttgcctttgtgctcgtgtttatccttcctgccttgaacctggtcagagttttattactgaggaagatgatgcacggagtgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaattcagtcttctgttaatttttaagttttggttagtgccacaaggaatttaactttttgatttgtataatagaaaactgaactaggaattgttagcggggttttgaaggatgtgtactttccttcaaaataaagtggtagattttcaaaattttacactagtcagttctttatattctaagttaaatgtagtttgtaaaattattttggttttcttctacaaaggaaaaaattggatttatatatataaggttactgcataatgatttcattttgataatgtgcagaatggcctcataagctcacagaaagtaaaaaaaaaaaaaaaaaaaaagaaaaaatcaggattccactgttttaaaagaaatctcagtttttattttggaatataaaatgtgtatttggtatatgtgaccaattttctatcccaaaaaacacccattcttagtaatgtcatgaattaaacacccttctaaaccaaaaaaaaaaaaaaaaacggtaacttgctttttatgtttgtgtttttaatttatgcccaatacatgctttactgactcagaggaacaattcctggacatataattgggtaatgcaaatttttatccactggtcatgatttgtcttaaaatgtttacttgcctccctaaaatattttggctgtgtaggtttggtgtttgtcctagaggattcttcaacagaaagtgatttattctttactgttttgtgaggtaatatggtttagaacatatgtataagctaaaaacagtattttactcagatcagtagttatcgtgtctatcagctataaaaaaaatcaactgccagccaagaactttaaaactttaagctgtgtattatagaaccgttttgtgtagcattggaatattgtccattttgtaagtcattgtgaatgttcttaattatcagcttgaaggtatttttgtattaaaagttgacattgaagaacctaagtggatgatgggatttggggccagtagtgaaagtatgtttcctctaaaatatttccctaaacagtggtatacatggttattttattatgagatttgtatatgttctgtgtttctctgtgaacaatgtttcagtctctctgtcaccatatgtaaggggaagtccacaaatatagactacattgcacaaaactaaaattgttaattacaagaaaatataggtgcttaccttttgaaggtttattaatacatatggttgtcacaatacgtatatatgataaatggtgtacatatacagatgtttatggtgtataaatttttctatacccaattagaattatcttcctgattctttattcaataacatgctaattcctcttctatgttctatagtgacagaatgctaacttttcttataccctggcagaggacagaggagtctggtctaggatggggaactgaatttttgaacgaaaaggaaagagaaaggatgaaaaaacaaacaaacaaaaaaacacacgataatgtttcttagtcattttgattggccatttgaacagtctacaagtttaacgttatttccagtgaagtaggatggctgacctagcaatacatgtttcttcaaaagggtaaacatgctttagtgacctaaagctaaattttgtacatttgacatcagggatgttataagtactgcacttaatacaaagctatttctcaattgtgttatttttgagacaaatttttcttcaccattaacttcttgttggtagctttttgttttgtaaaaattgagagatggcaatgcttatctcaaccagattatccatctgcagaattaaggtatgcaactggtaaataaaagacaaatgctccagtttgtctttctcaacctttgagttcttaacctttgagttaaaacctagtctaaatagtgggaatgtcttggtttacagtaaggttttcttgggaaggatcttggttttgtgatctatttgtgaattaaggagtagatgttaaccattattttatagataagtgatttgtacatggttagttataaataaaactggtactagaacccag

SEQ ID NO: 145223 - DNA, 4680 bp, Homo sapiens
  Payload ID: 8698
  Gene Symbol: KBTBD8
  Gene Name: kelch repeat and BTB (POZ) domain containing 8
  Uniprot ID: Q8NFY9
  ENST ID: ENST00000417314
  CDS Start-End: 50-1855
gaaatgacatttcctttttaaatagctggagtcggggccccatcgagaaatggccgcgtcggcagatttaagtaagtcttccccaacaccgaatgggattccatcttcagacccagccagcgatgccatggaccccttccatgcttgcagtattcttaagcaactcaaaacaatgtacgatgaaggacagttgacagacattgtagtggaagtggatcacgggaaaacattttcctgtcatagaaacgttcttgctgcaatcagcccttacttcagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaa

SEQ ID NO: 145224 - DNA, 568 bp, Homo sapiens
  Payload ID: 8698
  Gene Symbol: KBTBD8
  Gene Name: kelch repeat and BTB (POZ) domain containing 8
  ENST ID: ENST00000484414
  CDS Start-End: 70-568
gaaatgacatttcctttttaaatagctggagtcggggccccatcgagaaatggccgcgtcggcagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctc

SEQ ID NO: 145225 - DNA, 557 bp, Homo sapiens
  Payload ID: 8698
  Gene Symbol: KBTBD8
  Gene Name: kelch repeat and BTB (POZ) domain containing 8
  ENST ID: ENST00000460784
  CDS Start-End: 119-557
gcgatgccgtaactggctcggcacttcttgtagttgtacgatttttctcctcctagatttaagtaagtcttccccaacaccgaatgggattccatcttcagacccagccagcgatgccatggaccccttccatgcttgcagtattcttaagcaactcaaaacaatgtacgatgaaggacagttgacagacattgtagtggaagtggatcacgggaaaacattttcctgtcatagaaacgttcttgctgcaatcagcccttacttcagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaag

SEQ ID NO: 145226 - DNA, 984 bp, Homo sapiens
  Payload ID: 8698
  Gene Symbol: KBTBD8
  Gene Name: kelch repeat and BTB (POZ) domain containing 8
  Uniprot ID: Q8NFY9
  ENST ID: ENST00000460576
  CDS Start-End: 50-529
gaaatgacatttcctttttaaatagctggagtcggggccccatcgagaaatggccgcgtcggcaggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagat

SEQ ID NO: 145227 - DNA, 2955 bp, Homo sapiens
  Payload ID: 8699
  Gene Symbol: KEAP1
  Gene Name: kelch-like ECH-associated protein 1
  Uniprot ID: Q14145
  ENST ID: ENST00000171111
  CDS Start-End: 549-2423
gattgcgccactgcactccagcctgggcgtgcagatcagagcgagaccttgtctctaaaggaaaaaaaaaaagaaagaaagaaagaaaagaaaagaaaagaaaacctagcgaggtagataattttccctagatcctgcggccgccggaccacgaggccggcgctgtgcgttgttaaaaggagaatagcagatggtggcgcgcagccccgcgaggagacatccagcaacgaaatcgggagatggaagggacagtgagaaggggggcctggctgtgcgcccccgcccgatgccccactcctcgccgacgggcgccgggcacctgcgggaagggcgggagaatcgccgctcctttcccgccgcgccctttccgccctctccccgcctccttttcgggcgtcccgaggccgctccccaaccgacaaccaagaccccgcaggccacgcagccctggagccgaggccccccgacggcggaggcgcccgcgggtcccctacagccaaggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttcaccctg

SEQ ID NO: 145228 - DNA, 2648 bp, Homo sapiens
  Payload ID: 8699
  Gene Symbol: KEAP1
  Gene Name: kelch-like ECH-associated protein 1
  Uniprot ID: Q14145
  ENST ID: ENST00000393623
  CDS Start-End: 248-2122
gtgggcgggggtggggagcggcccctcagcggtccctaccgcctgaggccagggcccggggacttttattgtgacacggcgggcgcccggctctgcttagtcatggtgacctgcgcgcgctccgcgcctcccccacgcgcagcgatggaggcgccggggctcgggcggtggaggcggagccggagcgcggccatggcggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 145229 - DNA, 960 bp, Homo sapiens
  Payload ID: 8699
  Gene Symbol: KEAP1
  Gene Name: kelch-like ECH-associated protein 1
  ENST ID: ENST00000591039
  CDS Start-End: 325-960
gggatgtgcccgggctgcgggcatcgcgggccgcgagcgcccctgcggccgtgcccggagaccaggaaaacgggcgccacggcccagggcgcctccgagttccccgccaggactcggagggccaggagggcgcgacctgggtggatatttttgttggacggcgcaactcttggggtggcccgggagcggcggaaaccgagcgagagaaccaggaggcgctgcgcagaaggaggcccgggggctccgaggcgttgaggggctcgatctgcgttctggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggg

SEQ ID NO: 145230 - DNA, 986 bp, Homo sapiens
  Payload ID: 8699
  Gene Symbol: KEAP1
  Gene Name: kelch-like ECH-associated protein 1
  ENST ID: ENST00000591419
  CDS Start-End: 348-986
gcgggatgtgcccgggctgcgggcatcgcgggccgcgagcgcccctgcggccgtgcccggagaccaggaaaacgggcgccacggcccagggcgcctccgagttccccgccaggactcggagggccaggagggcgcgacctgggtggatatttttgttggacggcgcaactcttggggtggcccgggagcggcggaaaccgagcgagagaaccaggaggcgctgcgcagaaggaggcccgggggctccgaggcgttgaggggctcgatctgcgttctggggttggcagccgagaggccgcggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggag

SEQ ID NO: 145231 - DNA, 774 bp, Homo sapiens
  Payload ID: 8699
  Gene Symbol: KEAP1
  Gene Name: kelch-like ECH-associated protein 1
  ENST ID: ENST00000585845
  CDS Start-End: 1-389
atagcagatggtggcgcgcagccccgcgaggagacatccagcaacgaaatcgggagatggaagggacagtgagaaggggggcctggctgtgcgcccccgcccgatgccccactcctcgccgacgggcgccgggcacctgcgggaagggcgggagaatcgccgctcctttcccgccgcgccctttccgccctctccccgcctccttttcgggcgtcccgaggccgctccccaaccgacaaccaagaccccgcaggccacgcagccctggagccgaggccccccgacggcggaggcgcccgcgggtcccctacagccaagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctg

SEQ ID NO: 145232 - DNA, 582 bp, Homo sapiens
  Payload ID: 8699
  Gene Symbol: KEAP1
  Gene Name: kelch-like ECH-associated protein 1
  ENST ID: ENST00000590593
  CDS Start-End: 1-350
acctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggg

SEQ ID NO: 145233 - DNA, 1044 bp, Homo sapiens
  Payload ID: 8699
  Gene Symbol: KEAP1
  Gene Name: kelch-like ECH-associated protein 1
  ENST ID: ENST00000592478
  CDS Start-End: 1-517
ctgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttca

SEQ ID NO: 145234 - DNA, 979 bp, Homo sapiens
  Payload ID: 8699
  Gene Symbol: KEAP1
  Gene Name: kelch-like ECH-associated protein 1
  ENST ID: ENST00000592055
  CDS Start-End: 142-979
agtgcgcgggtggcatcactgtgcccggagcccctgcgcgccccggccatccccaccccgagggaccccctacggaggcgacctgggggctgaggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaact

SEQ ID NO: 145235 - DNA, 4115 bp, Homo sapiens
  Payload ID: 8700
  Gene Symbol: KLHL1
  Gene Name: kelch-like family member 1
  Uniprot ID: Q9NR64
  ENST ID: ENST00000377844
  CDS Start-End: 761-3007
gaaaattgtactgtgaggaccttgacagcttcacaggcgggctttttcttttgcctccctatatgcgctagaatatctatttttctcttttacaaactgactatataaaaccacctcttctggcattgcagaaagcaattgactttctcagagccacccggcaggctatcggggcatcctcgaaaaggccagggacaggggcgcaggtgcaccaagagatctggcgaggggtacgcttcctcgagacttggggctctttctctctgcgctctccagacactgaactctgagctgcaaggacaagaacgccaccaccttccctactaaggctctgccacaagcgcatcccagtgaggtgtatccagctgcagccgcctccggagcttcggagcgctcagacctccctccctcgcgcatctccagcctaagggttgtcccacctcgccataacacggggctctcgcgcgggcatcgaggattctcagcttttggcgtcccagtcctgcctctgctcctgcctggtggtgtccccacgcccaggtcctgcggacccgaccacggctgaaacgcgcggctttgccgtctgcgctccagccttcgcctggcagagcgcgcagcccacctagcgtcttctggctctaggggtgcagagggcgcatcccgcctcttcctccgcccccgggccccgctgtcctcccccacctgctgaccagcctactcctgcgtgagctgccagccttttgccttctgtgcgtaaagcatgtcaggctctgggcgaaaagacttcgatgtgaagcacattctgcgactccgctggaaactcttcagccacccgtctccttccaccggcggcccggcggggggaggctgcctgcaacaggacggcagtggcagctttgagcactggggacccagccagagtcgcctgctcaaaagccaagagagaagcggtgtgagcactttctggaagaagccttcctcctcttcctcttcatcgtcctccccgtcctcttcctcctcttccttcaatccgctgaatggcaccctgcttccagttgccacgaggctgcagcaaggggctcctgggcagggcactcagcagccagccaggactctcttctacgtggagtcactagaggaggaggtggtgccaggcatggactttcctggaccacacgaaaaagggctggttctgcaagagctcaaagtggagccagacaactctagccaggcaacaggtgaaggatgtggacacaggctgtcatcaaccggccattcaatgacacctcaaagtgatttggactccagtagctctgaagaattctatcaagctgttcatcatgctgagcaaaccttcagaaagatggaaagttatttgaagcagcagcaactttgtgatgttatcctgattgttgggaaccgaaagatacctgcacataggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctaggtgtaacagtacttgaaggccctatttatgctgtgggaggccatgatggctggagctatctgaatacagtggaaaggtgggatccacagagtcaacaatggacatttgtagccagtatgtcaattgctcggagcacagttggtgtagcagcattgaatggcaagttgtattcagttggaggtcgtgatggaagttcctgtttgagttcaatggaatattatgatcctcatacaaataagtggaacatgtgtgctcccatgtgtaagaggagagggggtgtcggagtggccacatgtgacggttttctttatgcagtaggaggtcatgatgctcctgcttcaaatcactgttcccggctactggattatgtagaaagatatgatcccaaaacagacacttggaccatggtggctcctttgagtatgcccagagatgctgttggggtctgtctccttggtgacagattatatgctgttggtggctatgatggacagacatacctcaacactatggaatcctatgacccacaaactaatgagtggacacagatggcttccttgaatattgggagagcaggtgcctgtgtggtagtcatcaagcaaccttgacttattgatattttacttggaaagattttacttgctggagtggttatttttatattgaatggcaagaatgagaacttccagagatgaaaactcttcaagaacaaggatctctgtagcgttacctactgatgttgaaagagttagtagatcaaacagaatagtaggaaacaagaaaacattaaacttatacaggaaaaatgtctggccatatgttagttagttcgggaatggttattggtaatttgttttgtattatagcatacaataactagagttaccaaaggcttgttttttcttgagcagttgaaaggagagaccaatatttgtgacatggatagtttcatgaccacaactcattcaatcattttatagtctatggcaatatccaagagattgccaagagtagaagacagaatatttcatctgacagtatctgattggtttactgtttttctaatcatatgtggtcataacgggaagcagaattatgctttattcaaacaaacctgcttctgcctcattttcctaagctatgagaacaattagagaaacagattcatgcttgtatcttgcattcagaaaacaaactgtcctactaatcaaagctgcatatctcatcagagataatggttgaattttattgcaaccatattggcaatctgaaactggcaaacacaaaggattgttttcactaggcttaccattttgctttgcttttttaacacactgagccaaagatgcagtgtaattattgggcttttgccttatgttgagttcagtgtaagcatggaagctagtgattctgaatgatatatatatccattgcatgttgaactcctttagaattttgttcttaaacaaacttagaatttcaaaagaaaaacatatgatccattaagttggagtgtttatgattattgctagaaagaaggcagacttcatattctcatcgcccatttttcaaacttgttacattgatctgtacattattttaagccacatgtttgtaattgtttaaaacaaagtggaaacattacacaatgtccttaataaataggcccatgtaaattttaattacaattaataaatgatcaaaaaatttgcattt

SEQ ID NO: 145236 - DNA, 3966 bp, Homo sapiens
  Payload ID: 8700
  Gene Symbol: KLHL1
  Gene Name: kelch-like family member 1
  ENST ID: ENST00000545028
  CDS Start-End: 795-2858
acttacaggggaggaggaggcgctgaggcagagagaaaattgtactgtgaggaccttgacagcttcacaggcgggctttttcttttgcctccctatatgcgctagaatatctatttttctcttttacaaactgactatataaaaccacctcttctggcattgcagaaagcaattgactttctcagagccacccggcaggctatcggggcatcctcgaaaaggccagggacaggggcgcaggtgcaccaagagatctggcgaggggtacgcttcctcgagacttggggctctttctctctgcgctctccagacactgaactctgagctgcaaggacaagaacgccaccaccttccctactaaggctctgccacaagcgcatcccagtgaggtgtatccagctgcagccgcctccggagcttcggagcgctcagacctccctccctcgcgcatctccagcctaagggttgtcccacctcgccataacacggggctctcgcgcgggcatcgaggattctcagcttttggcgtcccagtcctgcctctgctcctgcctggtggtgtccccacgcccaggtcctgcggacccgaccacggctgaaacgcgcggctttgccgtctgcgctccagccttcgcctggcagagcgcgcagcccacctagcgtcttctggctctaggggtgcagagggcgcatcccgcctcttcctccgcccccgggccccgctgtcctcccccacctgctgaccagcctactcctgcgtgagctgccagccttttgccttctgtgcgtaaagcatgtcaggctctgggcgaaaagacttcgatgtgaagcacattctgcgactccgctggaaactcttcagccacccgtctccttccaccggcggcccggcggggggaggctgcctgcaacaggacggcagtggcagctttgagcactggggacccagccagagtcgcctgctcaaaagccaagagagaagcggtgtgagcactttctggaagaagccttcctcctcttcctcttcatcgtcctccccgtcctcttcctcctcttccttcaatccgctgaatggcaccctgcttccagttgccacgaggctgcagcaaggggctcctgggcagggcactcagcagccagccaggactctcttctacgtggagtcactagaggaggaggtggtgccaggcatggactttcctggaccacacgaaaaagggctggttctgcaagagctcaaagtggagccagacaactctagccaggcaacaggtgaaggatgtggacacaggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctaggtgtaacagtacttgaaggccctatttatgctgtgggaggccatgatggctggagctatctgaatacagtggaaaggtgggatccacagagtcaacaatggacatttgtagccagtatgtcaattgctcggagcacagttggtgtagcagcattgaatggcaagttgtattcagttggaggtcgtgatggaagttcctgtttgagttcaatggaatattatgatcctcatacaaataagtggaacatgtgtgctcccatgtgtaagaggagagggggtgtcggagtggccacatgtgacggttttctttatgcagtaggaggtcatgatgctcctgcttcaaatcactgttcccggctactggattatgtagaaagatatgatcccaaaacagacacttggaccatggtggctcctttgagtatgcccagagatgctgttggggtctgtctccttggtgacagattatatgctgttggtggctatgatggacagacatacctcaacactatggaatcctatgacccacaaactaatgagtggacacagatggcttccttgaatattgggagagcaggtgcctgtgtggtagtcatcaagcaaccttgacttattgatattttacttggaaagattttacttgctggagtggttatttttatattgaatggcaagaatgagaacttccagagatgaaaactcttcaagaacaaggatctctgtagcgttacctactgatgttgaaagagttagtagatcaaacagaatagtaggaaacaagaaaacattaaacttatacaggaaaaatgtctggccatatgttagttagttcgggaatggttattggtaatttgttttgtattatagcatacaataactagagttaccaaaggcttgttttttcttgagcagttgaaaggagagaccaatatttgtgacatggatagtttcatgaccacaactcattcaatcattttatagtctatggcaatatccaagagattgccaagagtagaagacagaatatttcatctgacagtatctgattggtttactgtttttctaatcatatgtggtcataacgggaagcagaattatgctttattcaaacaaacctgcttctgcctcattttcctaagctatgagaacaattagagaaacagattcatgcttgtatcttgcattcagaaaacaaactgtcctactaatcaaagctgcatatctcatcagagataatggttgaattttattgcaaccatattggcaatctgaaactggcaaacacaaaggattgttttcactaggcttaccattttgctttgcttttttaacacactgagccaaagatgcagtgtaattattgggcttttgccttatgttgagttcagtgtaagcatggaagctagtgattctgaatgatatatatatccattgcatgttgaactcctttagaattttgttcttaaacaaacttagaatttcaaaagaaaaacatatgatccattaagttggagtgtttatgattattgctagaaagaaggcagacttcatattctcatcgcccatttttcaaacttgttacattgatctgtacattattttaagccacatgtttgtaattgtttaaaacaaagtggaaacattacacaatgtccttaataaataggcccatgtaaattttaattacaattaataaatgatcaaaaaatttgcattt

SEQ ID NO: 145237 - DNA, 2057 bp, Homo sapiens
  Payload ID: 8701
  Gene Symbol: KLHL10
  Gene Name: kelch-like family member 10
  Uniprot ID: Q6JEL2
  ENST ID: ENST00000293303
  CDS Start-End: 154-1980
actgcagggccaggattctggaacttgggttgcctgatagaccctatacaaaagatgtagtagggaaaaggagcgacagctggctaaaggggccccccacaaccctccccgacaccctaggaaagcagcctctctccgctgtcccagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcccgacatgatgaagctaatcattgagtatgcatacacccggaccgtgcctatcacaccggacaatgtggagaaactgcttgctgctgcagaccagtttaacatcatgggtatcgtcaggggttgctgcgagttcctcaagtcagagctgtgcttggataattgtatcggcatctgtaagttcacggactactactactgtcctgagctgaggcagaaggcctacatgttcatactgcacaactttgaggagatggtgaaagtctcggcagaatttttagagctctcggtcactgaacttaaggatatcattgagaaagatgagctcaatgtcaaacaggaagatgctgtatttgaggccattttaaagtggatttctcatgacccccaaaatagaaagcagcacatttcaattttgcttcctaaggttcgcctggccctaatgcatgctgagtacttcatgaacaatgttaagatgaatgactatgtcaaagacagtgaggaatgcaaaccagtcatcattaatgccctaaaggccatgtatgacctcaacatgaatggaccctctaattctgatttcaccaacccactcaccagaccacgcttgccctatgccatcctctttgcaattggtggctggagtggtgggagccccaccaatgccattgaggcatatgacgctcgggcagacagatgggtgaatgttacttgtgaggaagagagtccccgtgcctaccatggggcagcctatttgaaaggctatgtgtatatcattggggggtttgatagtgtagactatttcaatagtgttaagcgttttgacccagtcaagaaaacttggcatcaggtggccccgatgcactccagacgttgctatgtcagtgtgacagtcctcggcaattttatttatgccatgggaggatttgatggctacgtgcgtctaaacactgctgaacgttatgagccagagaccaatcaatggacactcatcgcccccatgcacgaacagaggagtgatgcaagcgccacaacactttatgggaaggtctacatatgtggtgggtttaatggaaacgagtgcctgttcacagcagaagtgtataacactgaaagtaatcagtggacagtcatagcacccatgagaagcaggaggagtggaataggcgtgattgcttatggagaacatgtatatgcggtaggtggctttgatggagctaatcgacttaggagtgccgaagcctacagccctgtggctaacacttggcgcacaatccccactatgtttaatcctcgtagcaattttggcatcgaggtggtggatgacctcttgtttgtggtgggtggctttaatggttttaccaccacctttaatgttgagtgctatgatgaaaagaccgatgagtggtatgatgctcatgacatgagtatataccgcagtgctctgagctgctgtgtagtaccagggctggccaatgttgaggaatatgcagctagacgggacaacttcccaggattagcactgcgagatgaagtaaaatattctgcttcgacaagtaccctacctgtatgagcctcttcatttagctaataaaaagtctaagcaataagaattaattctttttttaaaaaaatgcagtgtttaaactt

SEQ ID NO: 145238 - DNA, 641 bp, Homo sapiens
  Payload ID: 8701
  Gene Symbol: KLHL10
  Gene Name: kelch-like family member 10
  ENST ID: ENST00000448203
  CDS Start-End: 276-641
gaaatttgggttttaggacaggcgaaccaacccgctctccttcaagctcccggccatttcttggggcagagagctaggaggggtccgcggcagagcaaagcgggaaggcccaatgggcaggaagcctctccagccgcccccagcccggccggcccccgcacgccccagagcctcaattgacttggatttccttgagttcggtgtctagggagccaagtgttgggctgtggaaggtagatgaatgctccagggatagagacctgtatcagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcccgacatgatgaagctaatcattgagtatgcatacacccggaccgtgcctatcacaccggacaatgtggagaaactgcttgctgctgcagaccagtttaacatcatg

SEQ ID NO: 145239 - DNA, 566 bp, Homo sapiens
  Payload ID: 8701
  Gene Symbol: KLHL10
  Gene Name: kelch-like family member 10
  ENST ID: ENST00000438813
  CDS Start-End: 109-566
atacaaaagatgtagtagggaaaaggagcgacagctggctaaaggggccccccacaaccctccccgacaccctaggaaagcagcctctctccgctgtcccagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggagagaaatgtttccgtggctgctagtttctttcttttttccagagctttgtttacaagtggctggaacaacactgaaaagaaggtatacaacatccctggcatttctcccgacatgatgaagctaatcattgagtatgcatacacccggaccgtgcctatcacaccggacaatgtggagaaactgcttgctgctgcagaccagtttaacatcatgggtatcgtcaggggttgctgcgagttcctcaagtcagagctgtgcttggataattgtatcggcatctgtaagttcacggactactactactgtcctgagctgaggcagaa

SEQ ID NO: 145240 - DNA, 2383 bp, Homo sapiens
  Payload ID: 8702
  Gene Symbol: KLHL11
  Gene Name: kelch-like family member 11
  Uniprot ID: Q9NVR0
  ENST ID: ENST00000319121
  CDS Start-End: 62-2188
tgtgtcgtaccaacagccgcatcgttccgaggctgtggaggccgggcgcagcggcgtcaagatggcggctgcggcagtggcggcggcggcggcggcggccgcggctgcatctcttcaggtactggagatggagagcatggagacggccgccgccggctcggcaggactggccgccgaggtccgaggcagcggcacggtggacttcgggcctgggccggggatctctgcaatggaggcgagcgggggcgatccgggcccagaagccgaggatttcgagtgcagctctcactgctcagagctgtcctggcggcagaacgagcagcggcgccagggcctcttctgcgacattaccctgtgcttcggcggggctggaggccgcgagttccgggcccaccgctcggtactggctgccgccaccgagtacttcacgcccctgctctcgggccagttttccgagtcccgctcgggacgggtggagatgcgcaagtggagctccgagccggggcccgaacccgacacagtggaagccgtaatcgagtacatgtacaccgggcgcatccgcgtcagcacgggcagcgtgcacgaggtgctggagttggccgacaggttcctactcattcgtttaaaagaattttgtggagaatttctcaagaaaaaacttcatctctcaaattgtgtggcaattcatagcttagcacacatgtacaccctgagccaacttgctctgaaggctgctgatatgatacggagaaatttccacaaagtgattcaggatgaagaattttatacgttacctttccatctcattagagactggctttcagatttggaaattacagttgattctgaagaggttctctttgaaaccgttttgaaatgggttcagagaaatgctgaagagagagagagatactttgaagaactttttaaattgctcaggttgtcccagatgaaacctacctaccttactcgacatgtcaaaccagagaggctggtagccaataatgaagtttgtgtcaagttggtcgctgacgcagtggagagacatgctctgagagctgagaatatacaatctggcacatgccagcaccccacttctcatgtgtcactattgcctcgttatgggcaaaacatggatgtgatcatggttattggaggtgtgtcagaaggaggggactatttaagtgaatgtgtgggatactttgttgatgaggacagatgggtaaatctgccacatattcataatcacctcgatggacatgctgttgcagtaacagaatcctacgtgtatgttgctggatcaatggagccagggtttgctaaaactgtagaaaggtataacccaaatttgaatacatgggaacatgtttgtagtctgatgacaagaaagcattcttttggactaacagaagtcaaagggaagctctatagcattggaggacatggcaactttagtcctggttttaaagatgtgactgtttataatcctgagcttgataaatggcacaacttggaatcggcaccaaagattcttcgagatgtcaaagcactagccattgaagaccggtttgtatacattgccgcccgcactcctgtagaccgggacactgaagatggattaaaggctgtaattacttgctatgatacagagactcgacagtggcaagatgtggaatctttgccgcttattgacaattactgctttttccaaatgtctgtggtcaattcaaacttttatcagacagcatcatgttgtcccaagagttattgtttagaaaacgaagaggcagtaagaaaaattgccagccaagtgtctgatgagatccttgaaagcttgcctccagaagtcctaagcatcgaaggagcagccatttgctattacaaagatgatgtcttcattataggaggctggaaaaacagtgatgatattgataaacagtatcggaaagaagcctaccgatattgtgcggagaggaagaggtggatgcttcttcctcctatgccacaacctcgttgtagagccactgcttgtcacgtgaggatcccataccggtacttgcatggcacacagagataccctatgcctcaaaacctgatgtggcagaaggaccgcatcagacagatgcaagagatacatcgtcacgccctgaacatgaggcgagtgccaagctctcagattgaatgctaggttctctcaagcgtgccgattaaaactgttacacccgtttcgtgaagctgaagatacccaggctgttatttaaaaaagtatgtcgataacttattttctacatgaactgattattaccccatataaaggaaatagagttaaaaactaaagaatgggagactcagttcaatacatggtcattttgttagcttgcaa

SEQ ID NO: 145241 - DNA, 1033 bp, Homo sapiens
  Payload ID: 8703
  Gene Symbol: KLHL12
  Gene Name: kelch-like family member 12
  ENST ID: ENST00000367258
  CDS Start-End: 88-1033
gcagagtatatactgaggtctgtggatcctaaggctcagaggattctcgccgcagcgttgttcggcccgaaaaggccattgtggacaatggacgtgaataaatttgaggcctctgtgggttttctcgatgtcaaaaagttcctcagtacctggaagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctag

SEQ ID NO: 145242 - DNA, 2257 bp, Homo sapiens
  Payload ID: 8703
  Gene Symbol: KLHL12
  Gene Name: kelch-like family member 12
  ENST ID: ENST00000367259
  CDS Start-End: 122-736
tccccagtgcctaactctgctgtctgctatatttcagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctgatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactatgtgcaccgggtgattacaggcaccagtgcagtgatgattgtacttatttgacacatactccccgtcgtcctggttcttgttcctgagaagggtgggtaacagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtctttttttttttttccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgcc

SEQ ID NO: 145243 - DNA, 3359 bp, Homo sapiens
  Payload ID: 8703
  Gene Symbol: KLHL12
  Gene Name: kelch-like family member 12
  Uniprot ID: Q53G59
  ENST ID: ENST00000367261
  CDS Start-End: 220-1926
gtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactatgtgcaccgggtgattacaggcaccagtgcagtgatgattgtacttatttgacacatactccccgtcgtcctggttcttgttcctgagaagggtgggtaacagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtctttttttttttttccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggctaa

SEQ ID NO: 145244 - DNA, 3972 bp, Homo sapiens
  Payload ID: 8704
  Gene Symbol: KLHL13
  Gene Name: kelch-like family member 13
  Uniprot ID: Q9P2N7
  ENST ID: ENST00000262820
  CDS Start-End: 911-2878
attaagagcatgctactctgtacttcgctgctgcagaagagagagtgatatttgtgttactacagcatgttgtaaatgtgtgagattttgctcatctcagcttggaaataagaatagggaaaggagagcaacttgaatcagaagctactagaagaacctgcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtaggtatgttgttgtttcattttcatatgaaacccatctatgttttttcttgctactattggtcagaaatcaggttaataggtgcagaatatagtacagtgctgcagtatccctgttaaggtagaacaatggtattgcaagcttaaaaaaaaaaagcctggctgcttttattaaataaagctgcattgtatggtatgcacagtgcagtcctaaaaaaatatactgcagtcaacgcttttctggcactattgttgagttggaatgattgaatcatcatattgctttaggggacagaagaatttaaggaggtaccttacagccctattttacagattggaagcatcggtttaagggcactggcagaatcctttgcttgttctccgcggcagccactgctgtgtcagtacagtgtggaatggaagtcttagttggtagtctgttatggaaacgctctttactgttattgtagtaccgtggtgacaacatgccattgaaatggaaaacgagctctcctgctatctggaaattcccagttcctgtgcttaaaacatccaggtcaactccactttctccagcatacatatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 145245 - DNA, 5331 bp, Homo sapiens
  Payload ID: 8704
  Gene Symbol: KLHL13
  Gene Name: kelch-like family member 13
  ENST ID: ENST00000371876
  CDS Start-End: 2423-4237
cttggaattactcagataatcattcctttaagcatagattgatataattgtggcttggggtttgcagagaagtgttacctccttgcaatgttgaagaacagtgctcttcacattcaatcaataaacttaataaaggggagatagatgggaatattgaatctgctaagaaggttaacatggcatgtactgttaccaaagcagaaattagtagggagtgttttgaatgttaaaaagtcaaaagatactgataaaacatcatgaaaaagataattttagtccaggcttcttcagcttttgaagtaattaattaaaaaggcaagcatattatgttggcaagaaagggctgcattttcactttttgctttctgtttttaagagcaagagacaaatgacaaagtaaataagttgttacttgtagtttactcaaaaaagcaatttccgggatatgtcattgtggcaatgtgaattcagctttactcctatcccttttacatctgcagtttcataagaatgataattgatggtcatttaagcactgcataataaagaaatgtctttggaatgatctacagaaagaagattctgtattcattcagaggacatatattaagtctttcgtgctaggctctgtgcagggaatacagaaactaataaaacagtctgcttgaatatcctattaatataatctggatgaatagacattttctggttagggataacagtcaccatcaatcaatttctgacttttccaattgattctgtaattttaaacgtctgtccacaaaagttgtttaaaattgtgtgtgtgtgctatatatcataaatataacttaattctctttaaagctatctctgaaactctggtggaaggctatatccagtttcttttatgctttttaaaatcttaagttattctcttctttattaaatatctatcagaattgaattaaacatggttatatattattaattcatttttggttatactatggctctaatatcattaagaagaattgatgtcatccttaaggccagaatttttgctaattattgcaagatttaaaaccacttagttggtgtcataattcaaaaagcagaatctttagtatggtctttttcttgttaaaactgatcaacttggggttttaggtatgacaggaaaaaaaggtgaaacctttctgatattggatagctcagttagacagttagaaaagcaaataattcaaaattgaggaaattacagaaaaaatgaagagttccagcacttgaaaatctgctctccttcttttttcctaatgtctattttagcagtctttttagcagtctgtatcatgaatgcagaaccaaattcatgagccatgggctccccactcttaggcaggtgatccagagattattttagcaatgtatacctatggagaaacacaagatctcttctaaggaatgatgaaaggttattaataatggcacatttttagtataacctgagatttttaaactatcaaatgtattgtcatattctctttgcatctaagtgacctactgactaaggttctcctattcttacttatgccccttgaaaatactattgctgcaatacatgcaaatacagaattgcctgtatttatatttttagtattcatttctttgaaaagatggaaatgtgactagattgtagctattaaacaatcccaaactggtaagtgagagatactgctagaaaaagaaattatatcatgtgaaaaattttgttcagttggggttgattagaactactactaataacagaagataaagtaatgcattaatatataacaattaatcttttacttttattaatgggggtttggagtgggaatcagactagacctagattcaaaccctgggccaaccactttaataagtggtttctgacccttctttagtctgtgtataaaattattggcaagtacctgctatataatgactattcaataaatggtagctatcatttttatcttttcaaaattaggtgttccaaattaattttaactatatgcagcataatttgatggcattgctatctaaatagtaacatatcaacagtaattactgtggcctttaaaaactctgtgactataattttgaaccaccttttaagttgatttctcagttatcatctgtatattctgtacttggaaaccattttacaaatatacatttcttctaagataaagagtggtacaagcgtataatatagtgaaacaatattcaccatattgcatggtcatatgattgcaatagtgactgattatttttctaaataatctcattgtaaattgtacaagttttaatttccccttctttcttatgtaaaaaaactttcagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 145246 - DNA, 3234 bp, Homo sapiens
  Payload ID: 8704
  Gene Symbol: KLHL13
  Gene Name: kelch-like family member 13
  ENST ID: ENST00000371878
  CDS Start-End: 326-2140
gcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 145247 - DNA, 3256 bp, Homo sapiens
  Payload ID: 8704
  Gene Symbol: KLHL13
  Gene Name: kelch-like family member 13
  ENST ID: ENST00000371882
  CDS Start-End: 347-2161
ggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtca

SEQ ID NO: 145248 - DNA, 306 bp, Homo sapiens
  Payload ID: 8704
  Gene Symbol: KLHL13
  Gene Name: kelch-like family member 13
  ENST ID: ENST00000453826
  CDS Start-End: 194-306
cattatccaacttttagaggtgatggatcatctgcatagaggggaattggttgctgcaatacttcgtaaccggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaagg

SEQ ID NO: 145249 - DNA, 3972 bp, Homo sapiens; identical to SEQ ID NO: 145244
  Payload ID: 8704
  Gene Symbol: KLHL13
  Gene Name: kelch-like family member 13
  ENST ID: ENST00000447671
  CDS Start-End: 1064-2878

SEQ ID NO: 145250 - DNA, 2353 bp, Homo sapiens
  Payload ID: 8704
  Gene Symbol: KLHL13
  Gene Name: kelch-like family member 13
  ENST ID: ENST00000469946
  CDS Start-End: 203-2017
agagaatttgatgagagagggatccacaagaacatgacaaatgatgagagttcaaaccttaagagaaaaatgggcttattggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataag

SEQ ID NO: 145251 - DNA, 3322 bp, Homo sapiens
  Payload ID: 8704
  Gene Symbol: KLHL13
  Gene Name: kelch-like family member 13
  Uniprot ID: Q9P2N7
  ENST ID: ENST00000545703
  CDS Start-End: 387-2228
actgccccctccctccccaactgggttcccgcccccctccctcagcagcccccccacaccctggtgaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 145252 - DNA, 3396 bp, Homo sapiens
  Payload ID: 8704
  Gene Symbol: KLHL13
  Gene Name: kelch-like family member 13
  Uniprot ID: Q9P2N7
  ENST ID: ENST00000540167
  CDS Start-End: 383-2302
actgccccctccctccccaactgggttcccgcccccctccctcagcagcccccccacaccctggtgaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaaggtcattatccaacttttagaggtgatggatcatctgcatagaggggaattggttgctgcaatacttcgtaaccgatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 145253 - DNA, 3071 bp, Homo sapiens
  Payload ID: 8704
  Gene Symbol: KLHL13
  Gene Name: kelch-like family member 13
  Uniprot ID: Q9P2N7
  ENST ID: ENST00000539496
  CDS Start-End: 1-1977
atgatgagagttcaaaccttaagagaaaaatgggcttattggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 145254 - DNA, 3102 bp, Homo sapiens
  Payload ID: 8704
  Gene Symbol: KLHL13
  Gene Name: kelch-like family member 13
  Uniprot ID: Q9P2N7
  ENST ID: ENST00000541812
  CDS Start-End: 89-2008
tagaagagtgatatttgtgtgagagcctgggtcaggcttattttgagacgtgggccccactgaggtcattatccaacttttagaggtgatggatcatctgcatagaggggaattggttgctgcaatacttcgtaaccgatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 145255 - DNA, 1884 bp, Homo sapiens
  Payload ID: 8705
  Gene Symbol: KLHL14
  Gene Name: kelch-like family member 14
  Uniprot ID: Q9P2G3
  ENST ID: ENST00000358095
  CDS Start-End: 257-1423
cttttctccctctcctacattttcttgctgttgctaattcatggtgatcaaatgatgtacgacaaaataaattgtaaagagtgactgcctggagttgggaaccagaaggtgttttccccctcccaaggagacagcaaacctttaaaaaggaaggacaattgatttttggggggagcttaagtgagccttgactttgcagctggttgagaacaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggagaccaagaagctggccaacaagtacctggtggaggatgtgctgctgctcaacttcgaggagatgcgcgccctgctggactcgctgccgccccccgtggagtcggagctggcgctcttccagatgtccgtgctgtggctggagcacgaccgcgagacccgcatgcagtatgcgcctgacctcatgaagcgcctccgcttcgccctcatcccggccccggagctggtggagcgggtccagtcagtggatttcatgcgaaccgacccggtctgccagaagctgctgctggacgccatgaactaccacctgatgcccttcaggcagcactgcaggcagagcctggccagcagaattcgctctaacaagaaaatgctgttattggttggagggctgcctcctggaccggaccggctccccagcaatttggttcagtattacgacgatgaaaagaagacatggaaaatactcacaatcacaggaccacaccccatttcagggaagcaggaaagtgcaagctcaccagagttcagaaggaggaaaaccagagaattttcaaacaacacaatgtgactatcataattatactactagacatcaaatattcagtgtattcttctgctgtgctcaaagcgctctcacctctcctccaaggggagattacccaaaatcatcaagctcattgtggaggacctctgggtgagaagaatagtcatcccaacatcaagctgatttgagactcctcttgacccggaatgaataaactaaagagaaattatctggtccctcacacataatgcaccgtgatggaatagggacaggatcaccccagtaaacacgttcatttggaaagaccgtagcaatttagcaattctaccaaatagacattatgaagggcacctatccaagaggtgggttgtgttccttgattagggttctgcccaattctgttcattattttttttgttttcccatgccccctgcttctccctgtgggagatccttcttttcctgttatcttcattggccatgtc

SEQ ID NO: 145256 - DNA, 4312 bp, Homo sapiens
  Payload ID: 8705
  Gene Symbol: KLHL14
  Gene Name: kelch-like family member 14
  Uniprot ID: Q9P2G3
  ENST ID: ENST00000359358
  CDS Start-End: 440-2326
agcacgaccgtttctctccccaaccgtggatttcctattactctcgttacgactcactgagccccaggcccaaggataatgatgtgttgtttcttggtagcataatttgtcacacgtacattttttcttcttcttctcttgcagaaagctctgctccctctctctctccctctctctttctctcttttctccctctcctacattttcttgctgttgctaattcatggtgatcaaatgatgtacgacaaaataaattgtaaagagtgactgcctggagttgggaaccagaaggtgttttccccctcccaaggagacagcaaacctttaaaaaggaaggacaattgatttttggggggagcttaagtgagccttgactttgcagctggttgagaacaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggagaccaagaagctggccaacaagtacctggtggaggatgtgctgctgctcaacttcgaggagatgcgcgccctgctggactcgctgccgccccccgtggagtcggagctggcgctcttccagatgtccgtgctgtggctggagcacgaccgcgagacccgcatgcagtatgcgcctgacctcatgaagcgcctccgcttcgccctcatcccggccccggagctggtggagcgggtccagtcagtggatttcatgcgaaccgacccggtctgccagaagctgctgctggacgccatgaactaccacctgatgcccttcaggcagcactgcaggcagagcctggccagcagaattcgctctaacaagaaaatgctgttattggttggagggctgcctcctggaccggaccggctccccagcaatttggttcagtattacgacgatgaaaagaagacatggaaaatactcacaattatgccatacaacagtgcccaccactgcgttgtggaggtggaaaacttcttgttcgtgttgggtggagaggaccagtggaatccgaatggaaaacacagtacaaattttgtcagccgatatgatcctcgatttaatagctggattcaacttccacccatgcaggaaagaagagccagtttctatgcatgtcggttggacaagcatttatacgtaattggtggaaggaatgaaactggctacttgtccagcgtggagtgctataacctagaaacgaatgaatggcgctatgtgtcctctttgccacagcctctggcggctcatgcgggagcagtgcacaatgggaaaatatacatttcagggggtgtacacaatggagaatatgtcccatggctatattgctatgacccagtaatggatgtctgggctcgaaaacaagatatgaacacaaaacgtgcaattcacactttggctgtaatgaatgatcgcttgtatgcaattggaggaaatcatttgaaaggtttctcccaccttgatgtaatgcttgtggaatgctatgacccaaaaggtgaccagtggaatatactccaaactcccattttggagggtcgaagtggccctggctgtgcagtgcttgatgacagcatttaccttgtgggaggctacagctggagtatgggggcctacaagtcatctacaatatgctattgtccagagaaaggaacctggacagaactcgaaggagatgtagcagaaccgttggcaggccctgcctgtgtgacagttattctgccctcttgtgtaccatacaacaaataacaccaggaaactctggaatgaacagtatcacattctaggaagcaatggcaggtgacatcactattataataggaacaatgcattctaatggtacaactgccaaaacccacccttggtttctgatgatttataagtaactacaaaagaaagagacctgttcttgaacagatactatgtctataactcagatcgcaccaaacttcctgtggtgacagactcttccatttcagactggttttaacttatcccagctttacaaaaactcttcatgtgaatcttaacttgcaaaaggagaaagataaaatacagaagactggccccagagagacctcagatcagtattgtgcattgtagtctacctgcatgtgatctatgttgacatttcggggatattgtgttcaagaatgattccaaatttgagccaccaaaatacactgcattacagaaattgccacttgattctgtactcttaacctttggctacttcacagactccattggcaacactgttattgaaaatcatgtaagattaaagagaggcattttcgtttctatacaacttcatttcatacaccttctgcccttacagcacctcatgggatcagaaaagagaaagatgttggctcttgtaataaatgctttctaccctataggttctaggctagacagagtcgtcatttctgtgtcctcaattttatctgaaagattaaaacaaaatatattatgtcactattcagttcatggaggtttgtgctttttcatattttgtgatatataagtagtgaacacacatgttatttacttcaaaagacaggattgacaaattcagtcaatactattttagagattctgttagatgatatgtctgacccaaatttaatccataataaaaaaaaatgggagattgttttcaggaattcagggatgaaaagaaagaataatttccattaagtagaattccagttgtctttctgtttctaaaacacagaacttacaagagccacaggagccaattatagcacctgacagaatacttctcctcttcctcaccttcgggtgcctctagacacttgacttacgatcgttattcccccaattcatcatattttgtttgttatcaccagagatgcctgaactcagttaagcgagcaattgctagttgtcttgaggagcatgaggaattcaggagcagaaggtcaggatagcatgagatagtctcaatgtggccaaccaaaaggacaaaactgacaggaatgcacattcgattttcaagccctccagagcttgaacaacaactttaggagtaaataaaagcctaaaatatattttaaccatccagagatggtgttgaatccttcaacaaatgtgtcattcaaaacagtaattagggaaatcccacagatgaaaaatgccttagtgataagctttcatggcagagcacgtcaagataaatgggtatactggaatccgatgccgtttctacagtaaagtgcaatcttcgttgtttttgtatttatttgtatgttcagatccaaaggatccgttgtaaaaatatatatatataaatatatgtatatccagtgcaatcaactgtcatttctttttccttaaaacatatgagtatatagaaagaaaagttacagtactctgtgggaaaatctcagctgacatcatgaatagaatgaggtctgcttcagaaccttttgttgtcaactgtcactgtttcttccaaaagtcacaatttgtacaagaacctttgctttccttagacttgttctgcattttattttttatttctcaccaaaataaaagcatttatgagaattataagtaaagctttctgtatttcagagagacataagttactagaaagtgaaaagtgaataaataagtcacagagaatgtaaattttgtacagtattagaatgtgtaaatgaagcttgcttggaaggggaaaactttaaataaaaactttatgtactaatt

SEQ ID NO: 145257 - DNA, 765 bp, Homo sapiens
  Payload ID: 8705
  Gene Symbol: KLHL14
  Gene Name: kelch-like family member 14
  ENST ID: ENST00000583263
  CDS Start-End: 84-765
gggatccctccgagccgggcggcggcggcggctctcccccgggcgggcgggccggcgggccggcgggccggcgcgcgggcgggatgcaagcagagggtccctttctgctcagccctggaaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggaga

SEQ ID NO: 145258 - DNA, 6272 bp, Homo sapiens
  Payload ID: 8706
  Gene Symbol: KLHL15
  Gene Name: kelch-like family member 15
  Uniprot ID: Q96M94
  ENST ID: ENST00000328046
  CDS Start-End: 257-2071
gtttcaactcttgcttgaatcaagaacagaagcctctctttagacaggacttatccagagggggctgcaggcgagcactctcgtgccccgccggagcgacccggctcgtgccgggagcggctgctcgtagacgtccgaggagcctgccgagtgccgtcccggcgcccgaccgcccacccatcggcccgctggcccggttcttcctgatgcagactgccgtccactagaggctggacaggaccccccgaggtgattcatggcaggggacgtggaaggattctgttcctccatccacgacaccagtgtctctgctgggttcagagcactgtatgaggagggattgcttcttgatgtcactctggttattgaagatcatcagttccaggcccataaagcactcttggccacccagagtgattacttcagaattatgtttactgcagacatgagggaacgagatcaggacaaaattcatttaaaaggtctaacagctaccggtttcagccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttaagacatcagaattttatagatactcccgacagctccgttacgaagttgaccaagcattgaattactttcagaatgttcaccagcagcctttgttggatatgaagtcaagccgcatccgttctgcaaaaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaagaaaaacctcaccagttttactatcaaagccattggtctaacattgtaagaatttttcattctgtgctagcatcctttttttcttttcagtggcctcaaactcatgcaataagttaattctaagtgctagctcttgaaactacttccagaagcagttgaatagaatgctccacttatctgggatattgattttctgctttaaacatttctttcagatgttagcgtaggagtcatgtgtcttctaagagaagacccgataagtgtcactggatgtgatttcagtctctgtctctatctgaaacctttttgaagatttatttcagtgtatttcagtctgttatactttttagttttattatttaaaagtttaaaactcttgacctttttgcatggctttttgctgaaaatgcaaaaatataaattttctacaaaattaactttttatattcaaaacactatttctaagctgccttctcttatccgcattgtgttagtgaaagcatattcatactcgcatacaacctataaatacacaaggcacatcccttttatgcgtggttaggattctatatttttaagctagtgcacttacttgcacacacagttcgccatacttgttgaattttagatgtaacgtcttttcacatattaacatttttagaaagttgaaataactggagtcctcatttgctatcaaagtagcctatcttcagtccatactgattcagtaatatttgaactccttatatttctgaaacatgtatggttatgaaaactaacactttatattttattttcaaaagtaaatgttagtgttctttgtcgatgtatgtcttttctttttgaaaatgtttttctttgcagtctgtttaacgttaccctgtttttagtgagaatcggagtggtatatgacaagttctggccctgcagcatgcaagcacttttaaagagcatttaggtaataccagactcctaaatcaaggccccttaaaagtaagtgcaactcccattttttacattcagtaaggctgctgcatttgttattgaatggaaggtagaaactcttagaaaatttgacctcagttttgacttagaggtaagaaatagaattataatgttactggttttatctacttgtttattttgtacaaaatacccagcgacactagggatgtaagccctcagtttttgttttatttactgaaagctattagcatgaaggatagtaaccacaaagttcagaatggatcaagaatagctgtttaaaagcatttataataagtgttttaggattagctgcacctttcaactctttaaatgcagaggaaaaaacatagttgacaaagttaagcaagaataacctgggagtggatcattgaaattgatgccatttgcgcatgagtagtctatatctgatacagactagatctatactggcaaaacttgccagatcttagaatattggtgcaatattgcaatgccttctatatggctgctgatgtataaattttctagtttcactttgtttggtgttttttgtttttttgtttgtttgtttgtttttttgctgctgccaccattgaacataaaatggaagtgtgaagtcatggaaatgtgaagactttggtttttgggggttttttgggcagttattagacatactatgagattaaacctgatcttcaaactccagaattggaggcatttgggtttaagaaaccaggtacataagtagcttttgaaaaaaccattggcattgatttcaaaaatcaataataatcttattttatatatgagacttatattttcattaactagtcctgtcatttacttacagtttccaaacatgaaatttggtatcttgtttcccatggtaatatgggtaaaagtctttttctacatttaaaaaatacattattttatttttgaaagttaggaataagttagccatttaatttttttctacattagtttagtggctttgtatgtgtgctattttgctttaaagaaaataacgtcttcattattttcctcattgatgtcttttgctagaaaagaccaagaaagagccatcaggccaggtatccacatcaaagcctttacactatagtggtggttctctttaattgcttagatatgacttcatgaccctagtcagggtgacatctgggcaaacatttgagtattcttggtcttccattttaaagacagaggccaagatcaaagttcatgttttgtaaaattcgtaaaatcttaacttgaactaactctgggttcagctttacgtaagtcacgtcggacctgatgttagctgtaatcagttttgagctttaaggatagttgctgttgcttgggttctgaatgtatgagaaaactccctgtttatatgtagttctaatttaggttattttaaatccatgattaacttacattcccttttaaaattatggttttattgctgcaagagatttatttttgttatactaaactatggaaaagtttttcatagcatttttttcaagtttattttttgtgtgcttcatttggagtttttgtttatatacattgcgctcaaaaaagtagttttttgaaaaattcagtaagatttgaatctatacagtttaactgttatgacctttatgcgtgttgttttcactttatatctcaaatgccagagttcacaaaaatagctgatcttcattaattacatcttaattagaaccatttgttctcttccgtgtctttgaccttctaagttttgattttaaagaaattccttgcactacagccttttcttaaaatgcaagattctcactttgaaggttttgtgttggaagaaatgctactggtttttaaaaagcaaagcttaactaatagaattattagcttttcttgagacagctttctgtgtcctcattactctgctctgtgtgagtgttactagaatttgtgaaatactgactgagcccttcacttatcttttctaaagcagcacctttggacacctcattctgggaagcctgctcgagtcatagtaaaggacacacgctttatgtggggagaagtggtaaaaatggagttttgtcttaattacatgaaactaagctttaaaatattttataacagattatttgagctgcataatctaaacatgtcaaacgttcagtgggactatttttatatatgtatatgtgggtgtaggtcataacatttcagtttataatataaattgttatttcagtttataagctatctctcagaggagactagctcttttgagaattcataatttaaagttttagactgaagtaaaatgcaacatagataatagtgtaaatcagatataattgagggctatatggcagtaaaactgctagtgccagttttcttgtttgcctgttatacatttttgatttttgtttttgtattctgaacattttgagagatcatatgtttgttcaattacatttagagttggtttgggaataaatatcttctaaaaagagatttatcttaaaaatggaagtcctaaaaattagtttatccagagtttataaagtcaaatattcagtaggcatagactggaatagataaattcatggaaatcatatcctttcagtacaccgtataacttcaatattacacaagtaacattgaggagaatgccatcagctttgttctcccttaaattctttggttttctttttacattttgggaacaactgcatttaaaatgttattagtcagtatatagtaaggattaggtgtttgctttctgaaggaatggtccagtgaggtgattgggagaggttattttctacctaacttgtatatgccctatacctcttgggcatactttgtctatagaaaaatattttgacctttaggtacattttgggccagtagtcaaataatcctagggccgatataaaaatcttagaataatttaaggtttgccttttatacctgttttgaaagcctttacatttttgtcaggtaatttttcccaagccgtggatataatctattcaaacatgtttatgctatccattctgtttttaaattgaaaaaaatgttaaaagtgtttatgaagaaaagtttaaataaaatatttttaatctttaaaa

SEQ ID NO: 145259 - DNA, 2560 bp, Homo sapiens
  Payload ID: 8707
  Gene Symbol: KLHL17
  Gene Name: kelch-like family member 17
  Uniprot ID: Q6TDP4
  ENST ID: ENST00000338591
  CDS Start-End: 108-2036
agtgagcgacacagagcgggccgccaccgccgagcagccctccggcagtctccgcgtccgttaagcccgcgggtcctccgcgaatcggcggtgggtccggcagccgaatgcagccccgcagcgagcgcccggccggcaggacgcagagcccggagcacggcagcccggggcccgggcccgaggcgccgccgcctccaccgccgcagccgccggcccccgaggcagagcgcacgcggccccggcaggctcggcccgcagcccccatggagggagccgtgcagctgctgagccgcgagggccacagcgtggcccacaactccaagcggcactaccacgatgccttcgtggccatgagccgcatgcgccagcgcggcctcctgtgcgacatcgtcctgcacgtggctgccaaggagatccgtgcgcacaaagtggtgctggcctcctgcagcccctacttccacgccatgttcacaaatgagatgagcgagagccgccagacccacgtgacgctgcacgacatcgaccctcaggccttggaccagctggtgcagtttgcctacacggctgagattgtggtgggcgagggcaatgtgcagactctgctcccagccgccagtctcctgcagctgaatggcgtccgagacgcttgctgcaagtttctactgagtcagctcgacccctccaactgcctgggtatccggggctttgccgatgcgcactcctgcagcgacctgctcaaggccgcccacaggtacgtgctgcagcacttcgtggacgtggccaagaccgaggagtttatgctgctgcccctgaaacaggttctggaactggtctctagcgacagcctgaacgtgccttcagaggaggaggtctaccgagccgtcctgagctgggtgaaacacgacgtggacgcccgcaggcagcatgtcccacggctcatgaagtgtgtgcggctgcccttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggcggcgggagcctgtttgccatccacggagactgtgaggcctacgacacgcgcaccgaccgctggcacgtggtggcctccatgtccacgcgccgggcccgggtgggagtggctgcggtggggaaccggctctatgctgtgggcggctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggctatgacggggcctcctgcctgaacagtgctgaacgctacgaccccctgaccggaacgtggacgtccgtcgctgccatgagcacccggaggcgctatgtgcgagtggccacgcttgatgggaacctgtatgctgtgggcggctacgacagctcctcacacctggccactgtggagaagtatgagccccaggtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcctcccacatgccttaaggggaccgtggcccccaccagggacgtcctgcgccatccgttcacgtctctgcatccattccttcatgtctttatttagttgtttatttatttagttatttatcttatttattgaggggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggagcagttgtccttcctgtcgtcgtctgccgtgtgccatctttcctggatcttgtagtgggtgcacacgcgtgcactgggaccccacacagcaatacgagtccaacttaataaacacatttctggggttc

SEQ ID NO: 145260 - DNA, 913 bp, Homo sapiens
  Payload ID: 8707
  Gene Symbol: KLHL17
  Gene Name: kelch-like family member 17
  ENST ID: ENST00000466300
  CDS Start-End: 1-463
cttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggggcctctccaggagcctggggtgtggcccagcagtgggatccactcacgagtcccgtctccacctgccctccccaggcggcgggagcctgtttgccatccacggagactgtgaggcctacgacacgcgcaccgaccgctggcacgtggtggcctccatgtccacgcgccgggcccgggtgggagtggctgcggtggggaaccggctctatgctgtgggcggctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggctatgacggggcctcctgcctgaacagtgctgaacgctacgaccccctgaccggaacgtggacgtccgtcgctgccatgagcacccggaggcgctatgtgcgagtggccacgcttgatgggaacctgtatgctgtgggcggctacgacagctcctcacacctggccactgtggagaagtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcag

SEQ ID NO: 145261 - DNA, 1950 bp, Homo sapiens
  Payload ID: 8707
  Gene Symbol: KLHL17
  Gene Name: kelch-like family member 17
  ENST ID: ENST00000622660
  CDS Start-End: 455-1132
cgcgtccgttaagcccgcgggtcctccgcgaatcggcggtgggtccggcagccgaatgcagcccaccccaccccagtctttgtctttgactcccgaccccgttttgttcctgacacagccctgcccacaatccttagtgcctgctgtgtgtccccgagacctttctggatctgggccccccaggagcctcgtctgtggctcctgactctgctcggcccctcccagtatgaacactcagcccccacctgctaaccctccctcctaggcatcttcagggctccctgggtccacaggaccctccccagatctcaggtctgaggacccccactcccaggttctggaactggtctctagcgacagcctgaacgtgccttcagaggaggaggtctaccgagccgtcctgagctgggtgaaacacgacgtggacgcccgcaggcagcatgtcccacggctcatgaagtgtgtgcggctgcccttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggcggcgggagcctgtttgccatccacggagactgtgaggcctacgacacgcgcaccgaccgctggcacgtggtggcctccatgtccacgcgccgggcccgggtgggagtggctgcggtggggaaccggctctatgctgtgggcggctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggctatgacggggcctcctgcctgaacagtgctgaacgctacgaccccctgaccggaacgtggacgtccgtcgctgccatgagcacccggaggcgctatgtgcgagtggccacgcttgatgggaacctgtatgctgtgggcggctacgacagctcctcacacctggccactgtggagaagtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcctcccacatgccttaaggggaccgtggcccccaccagggacgtcctgcgccatccgttcacgtctctgcatccattccttcatgtctttatttagttgtttatttatttagttatttatcttatttattgaggggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggagcagttgtccttcct

SEQ ID NO: 145262 - DNA, 4620 bp, Homo sapiens
  Payload ID: 8708
  Gene Symbol: KLHL18
  Gene Name: kelch-like family member 18
  Uniprot ID: O94889
  ENST ID: ENST00000232766
  CDS Start-End: 21-1745
agttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagattggggaccacaaattcagtgcccaccggattgtcttagcagcctcgatcccgtatttccatgctatgtttacaaatgacatgatggagtgcaagcaggatgagattgtaatgcaaggaatggacccaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctcccccactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttgatctgtccaggagaacagaagggaaaaaaagatacttgaaagaaactgaaggaaatttaaacaaagaaacacttgaaagaaactggaaagaaaaataatttttttatgtgaacaaattttgcaagaagaaaaaagcataaaagacactaacggcaaatctatgtttaaatggaaaatcgtctaactggagaagggcggtatccaccccacattcggatcccagggtcctgaggcctcgcattgagctgggggttccctctgagccccagtgtgtgtggaatcagtgcactcttgactgggcctgtagtaaggtgctcatggggtttgtcttctcacccaccatcagaggacttttaaaatcataggcgtagagagttaggctatctgctgaattactgccactcttcttggtgggggctcctagctgtggctgggggctccaggcgcccctgtgattacctcctactgccaccatggcgctcattcagattccccactctcactaacattgcttccttttttgaccagcaggaaacagcaggtctggccagattctcacttgcccatcaatctcgttcttggatgatttccctcattgtgatgcttctggggcacgttgaccatatgcacctctagaacctaaccagggcttccttctaccagctgtgggcgggcttggtctggtaaccttgtctgctctgccattccactgctcctccatccactcgccaatcccaagagtctggcctccctccagccctgggcagactgaccagcaaggtggacctttacattcaagcacagctggcttttatgacataaagaactaaaggccgaaagaatctcttgctgctgcaaagaacagattttatatttcttcctctaatcttggcaaatgacctttaccttttggaaagatttcatattgcttcctcctccctggataggacctaatgtagcacagcgggactcaaagaggaggacattttctcttgccagtgcactgggcagtggggctgtccttcaactgctgctgccaaaattggttttctaaaattcttccagtagagactaaaagaagattcaattcctgtaacccaagactgagtcttagggctccagtctccacctgcttggtttcctatcctttgctgcctgcctggggtggcctggaagcctgttcagaaaggcacaatgtggagcctggggtgtctcccccaccccaggaccgtcaggtttaccagtgtgtgcaatcgccatgtattcagagggaagtacctttgttacctacaacttaggagctaggcctctgctacaagcacttgaaaatgatatttttatttttaacgtctcaacaatctgatatcggatgtcgtttaacctgggctcgtggtagggctccagcatttctccctccttcctggtttgcctgtaggggtagactcggaaggtgggtggggtgtgcatttcctgttaggagtgtatcagtgcttgtcttattataagcccctttcttttgtgaatttgaagtagcaccaacaagcctggattgtgaaggtattaagaatcggtctgtgggctactgagtgggtccttaggatactggcccagattttgccactgggtatggcagatcattttctaccatggcctgctgctcttgtagtggacttcctgagtccaatcccacctcctggtgtagaatttacactgctgcacctgaggtcgatgtttcaaagtaagatcaagccagtgttttgatctgggctctgagcacaagtcaggaaacaccaacatattcacactctcccagtaggttcctcagtccgatggtgaatggctattcgtaaatggctggtctggctctttggtgttggagcctttccaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaacactcctaata

SEQ ID NO: 145263 - DNA, 2249 bp, Homo sapiens
  Payload ID: 8708
  Gene Symbol: KLHL18
  Gene Name: kelch-like family member 18
  ENST ID: ENST00000442272
  CDS Start-End: 20-199
gttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctcccccactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttgatctgtc

SEQ ID NO: 145264 - DNA, 560 bp, Homo sapiens
  Payload ID: 8708
  Gene Symbol: KLHL18
  Gene Name: kelch-like family member 18
  ENST ID: ENST00000433449
  CDS Start-End: 50-241
agtgtctagccggccggcgaggcctgcgcagttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagccaactgaattttcagatgagatgagaaggtcatgcttttccacctttgagctcccactttgaccagctctgccagtcctgagccagaaggtcaacagttaaaaagaagagattggggaccacaaattcagtgcccaccggattgtcttagcagcctcgatcccgtatttccatgctatgtttacaaatgacatgatggagtgcaagcaggatgagattgtaatgcaaggaatggacccaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaac

SEQ ID NO: 145265 - DNA, 463 bp, Homo sapiens
  Payload ID: 8708
  Gene Symbol: KLHL18
  Gene Name: kelch-like family member 18
  ENST ID: ENST00000437353
  CDS Start-End: 21-463
agttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagattggggaccacaaattcagtgcccaccggattgtcttagcagcctcgatcccgtatttccatgctatgtttacaaatgacatgatggagtgcaagcaggatgagattgtaatgcaaggaatggacccaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaactgcctgggtgtgcgccagtttgctga

SEQ ID NO: 145266 - DNA, 3134 bp, Homo sapiens
  Payload ID: 8709
  Gene Symbol: KLHL2
  Gene Name: kelch-like family member 2
  Uniprot ID: O95198
  ENST ID: ENST00000226725
  CDS Start-End: 260-2041
gcgcccgccggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtt

SEQ ID NO: 145267 - DNA, 2452 bp, Homo sapiens
  Payload ID: 8709
  Gene Symbol: KLHL2
  Gene Name: kelch-like family member 2
  ENST ID: ENST00000421009
  CDS Start-End: 77-1567
gtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatg

SEQ ID NO: 145268 - DNA, 582 bp, Homo sapiens
  Payload ID: 8709
  Gene Symbol: KLHL2
  Gene Name: kelch-like family member 2
  ENST ID: ENST00000509704
  CDS Start-End: 231-582
ttcgtttttacttttggaacagagggagctaaaggaaagaacaagggaatacttagaatgcagttttatttggagatatctgctaagccacttctgctgaatattctgtgttgatctttgacggaacttggacaccagggagatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctg

SEQ ID NO: 145269 - DNA, 2887 bp, Homo sapiens
  Payload ID: 8709
  Gene Symbol: KLHL2
  Gene Name: kelch-like family member 2
  ENST ID: ENST00000506824
  CDS Start-End: 108-275
agaacagaggccagtggaaactattaggaagactcagcttttcatgaagttagatttttagcctgagctttaagtcaaagaaagatgacctggacttaaagtgccttatggtatggttggaagcacggccccagattctctttgtatgcacaaagcagggtcatcagaagcctctcgattcaaaagatgataataccgaaaaacactgcccagtgacagtgaatccttggcatatgaagaaagctttcaaagtcatgaacgaattaagaaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtt

SEQ ID NO: 145270 - DNA, 487 bp, Homo sapiens
  Payload ID: 8709
  Gene Symbol: KLHL2
  Gene Name: kelch-like family member 2
  ENST ID: ENST00000511305
  CDS Start-End: 55-487
tggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagacaatctcactctgccacccaggctggaatgcagtggcgtgatctcagctcactgcaacctccgactcctgggttcaagcgattgtcccacctcagcctcccgagtagctgggattacagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggct

SEQ ID NO: 145271 - DNA, 2169 bp, Homo sapiens
  Payload ID: 8709
  Gene Symbol: KLHL2
  Gene Name: kelch-like family member 2
  ENST ID: ENST00000506761
  CDS Start-End: 235-1518
gcacttgttaagacatgctatcgattgttccatgtgaaatactggcagtagtaaggcctcctggtgatctttcccagatggcctcattagcttttgcttagaagttccagttgtgaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttg

SEQ ID NO: 145272 - DNA, 2442 bp, Homo sapiens
  Payload ID: 8709
  Gene Symbol: KLHL2
  Gene Name: kelch-like family member 2
  Uniprot ID: O95198
  ENST ID: ENST00000514860
  CDS Start-End: 251-2044
tttttttccttgccaccccttggcctgtttgcctccactcccattaacatccctccaccatggatcccgtgtgccggatttgagacttgcaggcagtgtctttaggaaggaactttaccgggcctcactgccagagctgggctagaacagaggccagtggaaactattaggaagactcagcttttcatgaagttagatttttagcctgagctttaagtcaaagaaagatgacctggacttaaagtgccttatggtatggttggaagcacggccccagattctctttgtatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtatacca

SEQ ID NO: 145273 - DNA, 2907 bp, Homo sapiens
  Payload ID: 8709
  Gene Symbol: KLHL2
  Gene Name: kelch-like family member 2
  Uniprot ID: O95198
  ENST ID: ENST00000538127
  CDS Start-End: 294-1811
actgccagagctgggctagaacagaggccagtggaaactattaggaagactcagcttttcatgaagttagatttttagcctgagctttaagtcaaagaaagatgacctggacttaaagtgccttatggtatggttggaagcacggccccagattctctttgtatgcacaaagcagggtcatcagaagcctctcgattcaaaagatgataataccgaaaaacactgcccagtgacagtgaatccttggcatatgaagaaagctttcaaagtcatgaacgaattaagaaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagggcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtttca

SEQ ID NO: 145274 - DNA, 3421 bp, Homo sapiens
  Payload ID: 8710
  Gene Symbol: KLHL20
  Gene Name: kelch-like family member 20
  Uniprot ID: Q9Y2M5
  ENST ID: ENST00000209884
  CDS Start-End: 137-1966
ctgcctgcgttagcggcggtggaggaggaggcagagaggagtggagggcggagtagacggaggaggctgctgcagagaagaaagtgtcagagccggttcggctttagagtgtggtgaagggtacttttcatggtgcatggaaggaaagccaatgcgcaggtgtaccaacattcgaccaggagagactggaatggatgtaacaagccgctgcacccttggagaccccaacaaactgccagaaggggttccccaacctgcccgcatgccctatatctcagacaagcaccctcgacaaaccttggaagtgattaaccttctgagaaagcaccgggagctatgtgatgtggtgctagttgtgggcgccaagaagatatatgcccatcgagtcattttgtcagcctgtagtccctacttccgagctatgtttacaggagaattggcagagagccgtcagacagaagtagtgatccgagacattgacgagagggctatggaattactgattgactttgcgtatacctcccagataacagtagaagagggcaatgttcagactcttctgccagctgcttgcctcctccagctggcagaaatacaggaagcctgctgtgaattcttaaagagacaattagatccttctaactgcctgggcattcgggcttttgctgacacacattcatgtcgtgagttgctaaggatagcagacaagttcacccaacataactttcaagaggtaatggagagtgaagagttcatgttgcttccagccaatcaactcattgatataatatccagtgatgagctaaacgttcgcagtgaagaacaagtgttcaatgcagtgatggcctgggtcaaatacagtattcaggaaagacgtcctcaattaccccaggtgctgcagcatgttcgtttgcctttgcttagtcccaagttcctggtcggcacagtaggctctgatcccctcatcaaaagtgatgaagaatgcagagacttggtagatgaggctaaaaactacctcctattgccgcaagaacgaccactaatgcaaggaccaaggacgagaccacggaaacctatccgatgtggggaagtactctttgcagttggtggttggtgcagtggagatgccatttccagtgttgaacgatatgatccacagaccaatgaatggagaatggtggcttcaatgagcaaaaggagatgcggagttggggtcagtgttcttgatgatctgttatatgcagtaggaggccatgatggatcctcttatctcaatagtgttgaaaggtatgaccccaaaacaaaccagtggagcagtgatgtggcccctacaagcacctgcaggacaagtgttggtgtagcagtacttggaggctttctttatgctgtgggtggccaggatggtgtgtcttgcctcaacattgttgagaggtatgatccgaaggagaacaagtggactcgggtagcttctatgagtaccagaagactaggtgtggctgtggctgtgttaggagggttcttatatgctgtaggtggctctgacgggacatctcctctcaacacagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaataaaggtagtatttaccattaaaaaaattttagctaa

SEQ ID NO: 145275 - DNA, 4487 bp, Homo sapiens
  Payload ID: 8711
  Gene Symbol: KLHL21
  Gene Name: kelch-like family member 21
  Uniprot ID: Q9UJP4
  ENST ID: ENST00000377658
  CDS Start-End: 53-1846
gtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 145276 - DNA, 6445 bp, Homo sapiens
  Payload ID: 8711
  Gene Symbol: KLHL21
  Gene Name: kelch-like family member 21
  Uniprot ID: Q9UJP4
  ENST ID: ENST00000377663
  CDS Start-End: 185-1804
cgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtaaattttcaggcgggccagcattggaagcacaggctggtcctgattttgcaacccaagtgtcatcgtgatgagtgtttgggatccacagccatgatgggtgggtctcatctcaattaatagaaggctgctcttacccttattttgcacttaaggctcactgagacacagatgttaagtaataccctatgattacacagcttagtacacatttgagcagtgtttattgagtatctgctgtgagccagagagcagaaggaagtgagggagcaaggcatacagtcatctggggacacctgttccagagagggacagcaggtacagaggccctgcagcagggcaccctggcgtgttcttagatacaccagcagcccatgtggccggagcagagtcagcatgaggtctgtgacctaccttttttatttttgagacagggtcttgctctgtcacccaggctggagtgcagtggtacaatcatggctcactgcagcctccacctccttgactcgcagtcctcccaccgcaccttcctgaatagctgagactacaggcgtgtgccaccacacccagtaattttttttctcatatgtagatacaaaaggatattcttaaaatttttatagagacagggtcttgctgtgttacccaggctggtctcacactcctggcctcaagtgaccctcctgtctcagcctcccaaagtgctaggattataggcgtgaaccaccacgcccagctggttcctgaggaagtcagtgtgggaatactttttttttttttatacggagtctcgctctgtcacccaggctggagtgcagtggcacgatctcggctcactgcaagctccatctcccaggttcacgccattctcccgcctcaacctcccgagtagctgggactacaggtacccaccaccacgcccagctaattttgtttgtgtatttttagtagagacgggatttcactgtgttagccaggatggtctggatctcctgaccttgtgatctgcctggctcagcctcccaaagtgctgggattacaggcatgagccaccatgcccagcccactgtgggaatacttgtgttgagcacttgctgtgtgttctgaataggacaaccagggtccaccccttctctctgggcttgttgagaagaggggtgcccagcctgacagtgatgggacagggaggcttcagtgccatttggccatgtgagcagtgttagtctgaggtacacatcatattgcctacagccttctttcctgtgtgtctgttaacatttccaaacctacactccgtgacatccagcctcacagcttacatcacagcttaatgtcctggcatttaagagacccagcgttctgttttccccgcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggcccgttctcctaggcagggtgttggaaaggggttggcctctctgctgctttctgggagagccaaggccacccctctggggtactgacagggcatgccttgtctccagtggttccccaggtggggccctgccctaccctctcctctgacctccactcactcatccctttggcccacaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 145277 - DNA, 1056 bp, Homo sapiens
  Payload ID: 8711
  Gene Symbol: KLHL21
  Gene Name: kelch-like family member 21
  ENST ID: ENST00000467612
  CDS Start-End: 192-884
cgggggcctcgggagccgaccccggtccgaggggggcctaaaactcctcgagagcaaccggagccaggggcgggcggcggctcggaccgcgtccccgggggcggggaaagagtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcc

SEQ ID NO: 145278 - DNA, 667 bp, Homo sapiens
  Payload ID: 8711
  Gene Symbol: KLHL21
  Gene Name: kelch-like family member 21
  ENST ID: ENST00000463043
  CDS Start-End: 239-640
agggggcggggcgcgggccaccgggcccgggggatcgggggagcagccgggggcctcgggagccgaccccggtccgaggggggcctaaaactcctcgagagcaaccggagccaggggcgggcggcggctcggaccgcgtccccgggggcggggaaagagtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcagtaagctgcacatagtcatagcgaatttggg

SEQ ID NO: 145279 - DNA, 824 bp, Homo sapiens
  Payload ID: 8711
  Gene Symbol: KLHL21
  Gene Name: kelch-like family member 21
  ENST ID: ENST00000496707
  CDS Start-End: 148-824
ctgctgacaagctctgtggctccccaggagaactgtcccaaggcccagggctctggtctgctgaggtgtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccc

SEQ ID NO: 145280 - DNA, 1945 bp, Homo sapiens
  Payload ID: 8711
  Gene Symbol: KLHL21
  Gene Name: kelch-like family member 21
  ENST ID: ENST00000610898
  CDS Start-End: 1678-1785
ctctcgtggagtccgagcagctgcttcagggaggcccgggagcccctagggcgggcagccccggagcctgcagctgcgacgcagactcggaaactacaactgcgcgtgaagccgactaaagttaacgcctgtgtgattgagtcagaagctccttcaggaacacaggagtggggccgactcctggaatccggccccgggtcgcttataaatgcgccaagaaaaaaacgtcacccagtaattttttttctcatatgtagatacaaaaggatattcttaaaatttttatagagacagggtcttgctgtgttacccaggctggtctcacactcctggcctcaagtgaccctcctgtctcagcctcccaaagtgctaggattataggcgtgaaccaccacgcccagctggttcctgaggaagtcagtgtgggaatactttttttttttttatacggagtctcgctctgtcacccaggctggagtgcagtggcacgatctcggctcactgcaagctccatctcccaggttcacgccattctcccgcctcaacctcccgagtagctgggactacaggtacccaccaccacgcccagctaattttgtttgtgtatttttagtagagacgggatttcactgtgttagccaggatggtctggatctcctgaccttgtgatctgcctggctcagcctcccaaagtgctgggattacaggcatgagccaccatgcccagcccactgtgggaatacttgtgttgagcacttgctgtgtgttctgaataggacaaccagggtccaccccttctctctgggcttgttgagaagaggggtgcccagcctgacagtgatgggacagggaggcttcagtgccatttggccatgtgagcagtgttagtctgaggtacacatcatattgcctacagccttctttcctgtgtgtctgttaacatttccaaacctacactccgtgacatccagcctcacagcttacatcacagcttaatgtcctggcatttaagagacccagcgttctgttttccccgcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggcccgttctcctaggcagggtgttggaaaggggttggcctctctgctgctttctgggagagccaaggccacccctctggggtactgacagggcatgccttgtctccagtggttccccaggtggggccctgccctaccctctcctctgacctccactcactcatccctttggcccacaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgt

SEQ ID NO: 145281 - DNA, 2616 bp, Homo sapiens
  Payload ID: 8712
  Gene Symbol: KLHL22
  Gene Name: kelch-like family member 22
  Uniprot ID: Q53GT1
  ENST ID: ENST00000328879
  CDS Start-End: 158-2062
acgtgacggcccaggcccccgccccgccggctcctctcgcccagcctcccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 145282 - DNA, 792 bp, Homo sapiens
  Payload ID: 8712
  Gene Symbol: KLHL22
  Gene Name: kelch-like family member 22
  ENST ID: ENST00000443285
  CDS Start-End: 38-792
agctgcgagtgcggcctcggctggcggcggcaccagtatgggtttagggagtagctgccatttatcccttcccaagagagcagaggcactactatgctcacggaaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggccct

SEQ ID NO: 145283 - DNA, 742 bp, Homo sapiens
  Payload ID: 8712
  Gene Symbol: KLHL22
  Gene Name: kelch-like family member 22
  ENST ID: ENST00000458248
  CDS Start-End: 38-742
agctgcgagtgcggcctcggctggcggcggcaccaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcac

SEQ ID NO: 145284 - DNA, 724 bp, Homo sapiens
  Payload ID: 8712
  Gene Symbol: KLHL22
  Gene Name: kelch-like family member 22
  ENST ID: ENST00000451553
  CDS Start-End: 48-724
tccctccagctgcgagtgcggcctcggctggcggcggcaccagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggctt

SEQ ID NO: 145285 - DNA, 769 bp, Homo sapiens
  Payload ID: 8712
  Gene Symbol: KLHL22
  Gene Name: kelch-like family member 22
  ENST ID: ENST00000423364
  CDS Start-End: 447-769
gtactgtgatattgtgaaatatatatttggtcttgtctcatttcttggcatacaacttctaaaatctttggactttccagagtgatgcctttttgtatgctggccagcagcccctaggtagcttcaggatgggggctggtgacaggaaaggccaaggcaggcataagagggttgggactttcagcctcacctctcaacctccggagaggggagacaggctgaagattaagttcatcaccaatggccagtgatttaatcagtcatgcctacataatgaagcttccataaaaattctgaatgactgggtttggaaaacttctggatagttgaacacatggaggctcctaaagagtgatgttcctggagagggcctggaagctctgcaccacttcccacatgtctggccccatgcatctcttcatcttaaaggaaagtaggccctggaaatgccacccccttggcacccacctcccagactcctggctgtgtgtctcctgaccactactcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcag

SEQ ID NO: 145286 - DNA, 1045 bp, Homo sapiens
  Payload ID: 8712
  Gene Symbol: KLHL22
  Gene Name: kelch-like family member 22
  ENST ID: ENST00000444967
  CDS Start-End: 160-1045
tccagctgcgagtgcggcctcggctggcggcggcaccagttgaacacatggaggctcctaaagagtgatgttcctggagagggcctggaagctctgcaccacttcccacatgtctggccccatgcatctcttcatcttaaaggaaagtaggccctggaaatgccacccccttggcacccacctcccagactcctggctgtgtgtctcctgaccactactcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggacccca

SEQ ID NO: 145287 - DNA, 572 bp, Homo sapiens
  Payload ID: 8712
  Gene Symbol: KLHL22
  Gene Name: kelch-like family member 22
  ENST ID: ENST00000431430
  CDS Start-End: 98-572
tcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatgctgttcaccagcccaggcttgaatgggtgtcattctctctgcagatcccagaaattatccatttctgctgtgatttcct

SEQ ID NO: 145288 - DNA, 2087 bp, Homo sapiens
  Payload ID: 8713
  Gene Symbol: KLHL23
  Gene Name: kelch-like family member 23
  Uniprot ID: Q8NBE8
  ENST ID: ENST00000272797
  CDS Start-End: 339-2015
aagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggcggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttg

SEQ ID NO: 145289 - DNA, 4077 bp, Homo sapiens
  Payload ID: 8713
  Gene Symbol: KLHL23
  Gene Name: kelch-like family member 23
  Uniprot ID: Q8NBE8
  ENST ID: ENST00000392647
  CDS Start-End: 245-1921
acggcccggcgacgggggagttcccgcgagtggcctcgcgcccagaccgtgcggggggctgttcgggtggaggcgggggagccgccgggacaccaaaataggagctgcttgtggggtggagcggcactagctggcggcttccgagcgcctcttccaaagatggtcagaggggccggaggcgtccccgctcccgctcgctactagcccgcgggccagcgccgcgtcccgagccccggcgggagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggcggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatatatatatacacacacacatatatgtgttcatatatatgtatacatatatatgtgtatatatacgtatgtatacatatatgtgtatatatacgtatgtatgtatacatatgtgtatatatagtatgtatgtatacatgtatgtgtatatatacgtatgtatgtatacatatatgtgtatacatatatatgtgtgtatatatatacacatatatacgtatatatgtgtatatatatacacagttgaatcagtgggattaatacctataatctctggttttcaaaggtaatatagaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctcaaaaaaaaaaaaaaatcaatttagctagcaggaatttgacatttaaagagggaatcttctctacctctacaaaatcaacccttaacacttttttcaccttcagaattatttagaatgtggatttactttgtctagttttttcctttatagtgtaatttattgttactctctatttactgactaccagagatatacaaaatactgtgcaaaagattgttactgttcaaagagcttacaaactaaatttaaaagaatagcaagtctgaaaaatagaagatagtcaaatatttgtttatgctaagaactgtttttaattttcagctttgatgtaaattgctagcttagttgtctttagttcaagcatgttaggaaatcctctttattcttaaatatagatacatgtctgcatatatgattgaattttagagccagaaagcatgtagagcagttgtgattagtagaaaatacactgacaagaagatatttgcatttatttcccaaagctgccagtaactagattttgtgacttaagtcatttaacctctccttgattagagcttcctgagccatgcacactggcactgcaaatcacagacaggcctagatacagatcccctcaccccttgctacatccaaaggtggcctgggtggctggagcctctgggccagaaccacctttgtccattttcctcagtgtgcctacagcatcgctttccatgtgtgccataacttgggaatagttgggatgtgttgcttaactcctttacaccattagttatctgtgagaccatctattccacactcttcattttttaaaaagagacaataattatttttaactcactgaagtttaaaactacctagcatttctgattaaaaaaaatttagaaggaaaattttaatgcatttatttcagatggcgttttaaatagatacaaccctttggaaacacaatatggtactacatagcaagggctgtaaaaatgaccatatcctttgccccataaattctacttctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaataaaaataaatcactgtacatagtaaga

SEQ ID NO: 145290 - DNA, 895 bp, Homo sapiens
  Payload ID: 8713
  Gene Symbol: KLHL23
  Gene Name: kelch-like family member 23
  ENST ID: ENST00000437875
  CDS Start-End: 1-867
cttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagggaagaaaacttggtacgtaggagcattttctatttgatactccctaaagtcacagaaatcatggg

SEQ ID NO: 145291 - DNA, 594 bp, Homo sapiens
  Payload ID: 8713
  Gene Symbol: KLHL23
  Gene Name: kelch-like family member 23
  ENST ID: ENST00000448589
  CDS Start-End: 1-77
ccgatatcaacgaatggagcctcatcacctccagtccacatccaggcctgcccacaaaaaaaaccacaagaagatgaggtgaaaaattcctaggccctgccgtgcagccacagaaaataggaacctgcctgactgtggacatcaaatgaatttcaaggcctggaacctggatagcatggttcactgagtctaagaatgaatcaccttatatggtagtataagttgtttctgagctgatataactgggaatatagaaggcagggagcctgtcattctctgcctctttgacctagtagatagtttgctgtgcagagctggcaagaatgcaaactttatgtgtattctgggacatacaagggaggcaatgggaagcaacatttatccttctgcatctctatcttgtttatattctttgctctgcttcttagttcatccaaaactaaaccaaagtaaaatcaacttgaatgaaatccaagtctttattctctccattccccaaacctaggccagattctatggtctgattttcagcttacattctattgtccagctctgtttttacagtaaacacacacatttaataaaaggtgacaa

SEQ ID NO: 145292 - DNA, 843 bp, Homo sapiens
  Payload ID: 8713
  Gene Symbol: KLHL23
  Gene Name: kelch-like family member 23
  ENST ID: ENST00000498202
  CDS Start-End: 696-843
gagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggaaccagtcagaagcatctggattaggcatttagtgatacaaggatccagaataacaaaaactatgtaccagccacattcacacaacaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggcggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatc

SEQ ID NO: 145293 - DNA, 630 bp, Homo sapiens
  Payload ID: 8713
  Gene Symbol: KLHL23
  Gene Name: kelch-like family member 23
  ENST ID: ENST00000602521
  CDS Start-End: 406-603
ccagaagactctgttccctgtatatagaataggagtaatatttgaaaacaactggctgatgtttaaaactgaagattgtcatgattgtttatcctaatcccaatgctgaagtaagattgtcttggaaatactaagttgggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggcggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaat

SEQ ID NO: 145294 - DNA, 2345 bp, Homo sapiens
  Payload ID: 8714
  Gene Symbol: KLHL24
  Gene Name: kelch-like family member 24
  Uniprot ID: Q6TFL4
  ENST ID: ENST00000242810
  CDS Start-End: 351-2153
ggccagggttcgctgacgctcagtgttttggcccggacggtcacatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaa

SEQ ID NO: 145295 - DNA, 7380 bp, Homo sapiens
  Payload ID: 8714
  Gene Symbol: KLHL24
  Gene Name: kelch-like family member 24
  Uniprot ID: Q6TFL4
  ENST ID: ENST00000454652
  CDS Start-End: 387-2189
gttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggaagcccgggggagtgcgaccgcctcaaatccagccttcttgtttggtgggacgaccgtcggttctgtccgggaggaatgacggggtcaaggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaaggaaaaatgacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaactttatattctagtatttttctgttgtaaaaagtattaactatttacttttattttgttatacatttattttaatatccatgtgtttattatagtaaatttgaaatgaaatcctgaaaaacagaatttttttaaacacagacctcacaccaatattaattttttctctacataatttaaaactacataaattaagtacttaaaatttatattgaaggccaccaagaacttaggttgaatcttagaaaatttaaataactatttttaaagttacccaacttaatattttaattttttaatatttatcttcctttactaattcttgataaataatagcattagacttgataaaataaaaaagaattttagagtagaattaatatatcaaaaggggtatatcaaccaaattggtgtcagattgtattcattctctcatcacataaagatttttcttttgataggtgatgctcatatgaacctttggtttagaatctatatatgtacatgtgtatgtatgtagatagtatggttgtatacacacatatataccaaacaccatgaattttagcagtctgtgatgatcagcaaaaaagcacataaagtaaaaattagttgaccatgctaaattcaattctggaatttttttttatttgggcatttctagaactttttacatttgaaagtacatgatgagtattagtaacgatgacttatgtataatcagaatctttatgacaatttagttttacaaggtcagaagagatgagtttgctaaacccagctgtgatacctcagttggaaagggaattcaaaggtatgctttgtagaacagaaaagtatagtttttttttcatgaactttaatcattttctgtttttcctctatgtgagtcagctacaaaagtggtctaatttttacaacagtagaacttcctccttttctactgtaatcttcccactgactttactgcacaggtatgaaatactagtgtattggatcttcagtaacctttttatttcctagatgattgaaatataggtatttactccatttaaaccaggtgataagatgatgtaaatactcagggagggtattaacttgttacttttgctcgtttggggtgtaaagtgccatgactgaataatcttcaattcatgattctagagtaagtttaatttggaaaaaggggcttcacacatggtggtggttgaacattgattcttttatacttaaaaagatgaaaatgttttgtggactgatacattttatcttactgaatatgaattgtttatgtatctctactgtcaaatagcctttttgaaactcaggaaagacaaaggttcaattacaccacttttgtcaataagcaaaccaggtattttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtatttttttcgtttttttttttttttggggaaggggggagaacggggtcttgctctgtcgcccaggctggagtgcagtggcgcgatctcagctgactgcaacctccacctcccgggttcaagggattctgcctcagcctcccgagtagctgagaccacaggtgcgtgccaccacacccggctaatttttttgtatttttagtagagacggggtttagtagagacggatcactcctgaccacgtgatccgcccacctcggcctcccaaagtgctgggattacaggcgtgagccaccacccccggcctgtattttcagagaggagagcttggtgtttttgtggtgccaagtggtaagataatgtctctttgaggcttcctatggactgcctttattttagtaaactcaagacaccagttaacctcaacagagttttggccttattagaatttgttgtgcatcttattgaaagccaggtttacatcacctcaccccattattctttttagttaaataaatttaccatgccaagtaaccagaatggagcaaattggttgatctttaaggcagtaggtttgactagctagctatcattattgtcacatctaatgctaggcaccagaaaccatttgagccaggagtgtgaatgaataattccagagacactttagacattttttaatgttttatatgaacattttacatttgtgtgattgccttagatattaaattttcctagtgctgataaaaacagcaacattcataacttattttatatattgttccaaagaaaagaatttgttttaatggtttcaaaataactgcacctgaatttgtttatgtgccttaagttctctagtgctatttcaacttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccatta

SEQ ID NO: 145296 - DNA, 563 bp, Homo sapiens
  Payload ID: 8714
  Gene Symbol: KLHL24
  Gene Name: kelch-like family member 24
  ENST ID: ENST00000437402
  CDS Start-End: 382-563
ctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaaggctggagtgcaatggtgcgatctcggctcactgcaacctccgcctcccgggttcaagtgattctcctgtctcctgggttcaaccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtga

SEQ ID NO: 145297 - DNA, 562 bp, Homo sapiens
  Payload ID: 8714
  Gene Symbol: KLHL24
  Gene Name: kelch-like family member 24
  ENST ID: ENST00000427201
  CDS Start-End: 222-562
gttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagc

SEQ ID NO: 145298 - DNA, 603 bp, Homo sapiens
  Payload ID: 8714
  Gene Symbol: KLHL24
  Gene Name: kelch-like family member 24
  ENST ID: ENST00000454495
  CDS Start-End: 253-603
tttgttgtgagctgcggcagagactggtggctggaggagacgccggcgctggagagtgcgctgcgccgcccgccgctgagggaccgcggggttagccactgctggctgcttccagtgttcgccgagaggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatg

SEQ ID NO: 145299 - DNA, 588 bp, Homo sapiens
  Payload ID: 8714
  Gene Symbol: KLHL24
  Gene Name: kelch-like family member 24
  ENST ID: ENST00000482138
  CDS Start-End: 187-588
gttgtgagctgcggcagagactggtggctggaggagacgccggcgctggagagtgcgctgcgccgcccgccgctgagggaccgcggggttagccactgctggctgcttccagtgttcgccgagagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagag

SEQ ID NO: 145300 - DNA, 627 bp, Homo sapiens
  Payload ID: 8714
  Gene Symbol: KLHL24
  Gene Name: kelch-like family member 24
  ENST ID: ENST00000493074
  CDS Start-End: 246-627
acatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccgccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaa

SEQ ID NO: 145301 - DNA, 613 bp, Homo sapiens
  Payload ID: 8714
  Gene Symbol: KLHL24
  Gene Name: kelch-like family member 24
  ENST ID: ENST00000468001
  CDS Start-End: 237-613
ggacccgccctcaagttctggacaccccgggtgaagactgttaacgcggcggggattgggcgcctgcggcagcttgtgggcggtacccgagggagagttcgagtttttattggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatac

SEQ ID NO: 145302 - DNA, 2126 bp, Homo sapiens
  Payload ID: 8714
  Gene Symbol: KLHL24
  Gene Name: kelch-like family member 24
  Uniprot ID: Q6TFL4
  ENST ID: ENST00000476808
  CDS Start-End: 1-1614
atggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggtaataacataaagcagtacaaaagaaaaataaatctaagagggaccaagtacataatcattattaatacactggaatttcaattttaaaatatttcaggctgggcgtggtggctcacgcctgtaatcccagcactttgggaggccgaggtggatagatcacttgaggtcaggagttcaagaccagcctggctaatatggtgaaaccccgtctctactaaaaaattatggccaggcgtggtggttcatgcctgtaatcccagcactttgggaggctgaggcaggccaatcacctgaggtcgggagttcgagaccagcctgaccaacatggagaaaccccgtctctgctaaaaatacaaaattagctgggcgtggtggcgcattgcctgtaatcccagctactagggaggctgcggcaggagaattgcttgaacccgggaggtggaggtcgcggtgagccgagatcgagccattgcactccagcctggacagcaagagcgaaactccgtctcaaaaataaataaa

SEQ ID NO: 145303 - DNA, 542 bp, Homo sapiens
  Payload ID: 8714
  Gene Symbol: KLHL24
  Gene Name: kelch-like family member 24
  ENST ID: ENST00000473045
  CDS Start-End: 324-542
gttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggaagcccgggggagtgcgaccgcctcaaatccagccttcttgtttggtgggacgaccgtcggttctgtccgggaggaatgacggggtcaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaa

SEQ ID NO: 145304 - DNA, 574 bp, Homo sapiens
  Payload ID: 8714
  Gene Symbol: KLHL24
  Gene Name: kelch-like family member 24
  ENST ID: ENST00000468101
  CDS Start-End: 341-574
gttgtgagctgcggcagagactggtggctggaggagacgccggcgctggagagtgcgctgcgccgcccgccgctgagggaccgcggggttagccactgctggctgcttccagtgttcgccgagaggaagcccgggggagtgcgaccgcctcaaatccagccttcttgtttggtgggacgaccgtcggttctgtccgggaggaatgacggggtcaaggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttcct

SEQ ID NO: 145305 - DNA, 3758 bp, Homo sapiens
  Payload ID: 8715
  Gene Symbol: KLHL25
  Gene Name: kelch-like family member 25
  Uniprot ID: Q9H0H3
  ENST ID: ENST00000337975
  CDS Start-End: 276-2045
cttttctgcggctgcactgaagggttcggctgcccatccgtcacagaggcgatgcctctgattggctgctgctcttcgggccgggaggcggggcgggaaggccggagaaactagtttgttggcggcgcctaggctgtatcgcagcgagagcgtttttgcctgtggagagccggccgacgggagccgcggcggagcctgttgagctcgcgcgggctgccgggagtggtctctgaggcggcggcggcggcggggatcgtctccggcactgacgcaccatgtcggtcagtgtccatgagacccgcaagtcgcggagcagcacggggtccatgaacgtcaccctcttccacaaggcctcccacccggactgtgtgctggcccacctcaacacgcttcgcaagcactgcatgttcaccgacgtcacactctgggcgggcgaccgtgccttcccctgtcaccgtgccgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgaggccatcctccagtgggtgaagcacgacctggagccacggaaggtccacttgcccgagctcctccgcagcgtgcgtctggccttgctgccgtccgactgcctgcaggaggccgtctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggctctgctggcacactcaggagcctggccgcggggactgcagggagggtgcctggacccgtggggttgcttcattgagataaagcacacttatcacatagcacaaaggacgtgccatggtgctttccccaaaagttgtgttgcttttatcagttttctaacttaataaaaagagttgagaaaattc

SEQ ID NO: 145306 - DNA, 4407 bp, Homo sapiens
  Payload ID: 8716
  Gene Symbol: KLHL26
  Gene Name: kelch-like family member 26
  Uniprot ID: Q53HC5
  ENST ID: ENST00000300976
  CDS Start-End: 91-1938
agacctggccccgccccgccccccgcgtctcggtttcccgggcctgcgcgcgcggctcccgtcactcgaacgcgcgacggcggggggaagatggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggacgtgctgggcgcggccgtgttcttgcagatgctgcccgtggtggagctgtgcgaggagttcctgaaggcggccatgagcgtggagacctgcctcaacatcggccagatggccaccaccttcagcctggcctcgctgcgagagtcggtggatgccttcaccttccggcacttcctgcagatcgccgaggaggaggatttcctgcgcctgccactggagcgcctggtcttcttcctgcagagcaaccggctgcagagctgtgccgagatcgacctgttccgcgcggccgtccgctggctgcagcatgacccggcccggcggccgcgcgccagccacgtgctctgccacattcgcttcccgctcatgcagtcgtccgagctggtggacagcgtgcagacgctggacatcatggtggaggacgtgctgtgccgccagtatctgctggaggccttcaactaccaggtgctgcccttccggcagcacgagatgcagtctccgcgcaccgccgtgcgctcggatgtgccctcgctcgtcaccttcggcggcacgccctacaccgacagcgaccgctcggtcagcagcaaggtctaccagctgcctgagccgggagcccgccacttccgcgagctcacggagatggaggtaggctgcagccacacgtgcgtggccgtgctggacaattttgtgtacgtggccggggggcagcacctgcagtaccgcagcggcgagggcgcagtggacgcctgctaccgctacgacccccacctgaatcgctggctgcgcctgcaggccatgcaggaaagccgcatccagttccagctgaacgtgctgtgcggcatggtgtacgccacgggcggccgcaaccgagccggcagcctggcctccgtggagcggtactgcccccggcgcaatgagtggggctacgcctgctcgctgaagcgccgtacctggggccatgctggggccgcctcagggggccgcctctacatctcgggtggctacgggatctcagtggaggacaagaaggccctgcactgctacgaccccgtggccgaccagtgggagttcaaggcgcccatgagcgaaccccgcgtgctacacgccatggtgggtgccggcggccgcatctatgccctcgggggccgcatggaccacgtggaccgctgcttcgacgtgctggctgtggagtactatgtgccggagacggaccagtggaccagcgtgagccccatgcgggccggccagtcagaggccggctgctgcctgctggagaggaagatctacatcgtcgggggctacaactggcgtctcaacaacgtcacgggcatcgtacaggtgtacaacacggacaccgacgagtgggagcgggacctgcacttcccggagtccttcgcaggcatagcctgcgcccccgtcctgctgccccgggccgggaccaggaggtagcccccaagacccccgggaccctggcctgaccgcatgttgtctccaagtggggcttggcgaatgcacgtctgcctgagaaccccagtgccccccttcgcccgggctgcccttgaggggcctgctgcgttgataagcccccctcccaggggtccctccctccctccttcccaaagcagatcctggctgcgagtccatccgagggagcctgccggcaaagcgtctgacatgtggtggcagcaaattcgtccccggggtggtttcctcgcctggcccccgagtccccacgggctggcgggtggaatcccaggtctccagggggtccctgtgcagctccatctcacttctctactgcctcccagccccacggtttcaggcattcagatgtgagctcatcaacattgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggaggaggagggcacgtgtctgcctcccctggggtgccctccttcccccatcccaagctgctgaggggaggccctggtcatgcctcagttcctgccttcatctgctttccggaggaaaaaccatatcaactcctagaaacgctccttaggggcttgggaccttccatttggcactgagcatcttgtggggccttaactggctgagacatcccggccctctacatttgccctgttggccaggcagtccccttcccgcaattggagggcgacgctaacttcagaatcccatagtggcgcttgccgcaggtctggtggggtgtcttttttctcctccctcctttccacccctccgcgccctgccactccctggcctgccctgtttttgggtcaacattgctacggagccagcagtgaggcctttcccttcaagggctctgtggtatctctggccacatttgttctaatgtctgaacctctaaatcttttctttttgattggttttactgtttttaagaagccagcactgctgtctcatagatgggatttgtactcttggggcaacttaaagtgtctctctcgctgctaacagacgattgatgtcttgtctctgtgacccactcaccatgtaaagaattaacctcctatcttagcagacatcgtctcctaatatttccctttatttaataaaaatgttatggtgaagagatggagccggcccagcactgagcttgtgcggcttgggtctgattggtcacagattcctcgtgtgtcctccgcgtgtctgggggctcctctcccccgcctcaaccttttccagcctttcagaggagtcggcagtgggctgggctttggctcaggggcgcagaggcagcaggaagcgtggccaggactttcaccctggcgttttttgttgttggtttttttgtttttttgagacggagcctcgctctgtcacccaggctggagtgcagtggcgtgatctcggctcactgcaacctctgcctcctgggttcaagcaattcacctgcctcagcctcccaagtagccaggattacagacgcagacacacaccaccacacccggctaatttttgtatttttagtacagacggggtttcaccatgttggccaggctggccttgaactcttgacctcaggtgatccacctgcctctgcctcccaaagtgctgggattacaggtgtgagccaccatgcccggaccaaccttggcactttggaagagccttcagccccctattctcatcatggccggccaaactatgaactgggctgcccagagcaggccacttatcagttgcaggttagcagagaaagcctgatgttcccggacggccttcccagaagggaggccctgggatatcacacacacatggatctccataagttgctgtgcctgcatgcctggcgctcctgtgtggcagccatcggggctggggtaacactagaggctgagggggtgggcagtgctaaaataggaacatggttgggaacctaaaagaagcccacactgtcaggggcatcgagacaaaagccgagttccctggggacttaccagaacattccagccccacccccgacctgagctcccccaaagagaacccttccccactggaggcatggccccttcaggggagcagtgagaagctttgccagctgcaagtcccctggatcagctcacacctcagaacatcttgtccccagtgagctggcaggggcgccggcccagggcggggggcgctgctgtatctaaccggatcgattgtgcataaccgtctaggccggttcgtggaatgttcgtggggccccctgcccctccctcagcctccccccgcatccccccaagaaaggaaaattatttttcgtattgtaaactttaaacatgaaaaagctgtttttaattta

SEQ ID NO: 145307 - DNA, 554 bp, Homo sapiens
  Payload ID: 8716
  Gene Symbol: KLHL26
  Gene Name: kelch-like family member 26
  ENST ID: ENST00000595423
  CDS Start-End: 1-554
ggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcaggctactgttccccaggccagatcattcctggctggccaaaacacccctcagccactgccagccacacgttgtgtttctgcccttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggacgtgctgggcgcggccgtgttcttgcagatgctgcccgtggtggagctgtgcgaggagttcctga

SEQ ID NO: 145308 - DNA, 577 bp, Homo sapiens
  Payload ID: 8716
  Gene Symbol: KLHL26
  Gene Name: kelch-like family member 26
  ENST ID: ENST00000600657
  CDS Start-End: 28-168
actcgaacgcgcgacggcggggggaagatggcggagtccggcggtagcagcggtggtgctggtggcggcggcgctttcggcgcgggcccgggccccgagcgcccgaacagaaccgttctggggctttggatcgcttctcatgggttgggaagccgaccatggagatgaggccagcccggggccggaggaggggcgcctgccctgacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggacgtgctgggcgcggccgtgttcttgcagatgctgcccgtggtggagct

SEQ ID NO: 145309 - DNA, 989 bp, Homo sapiens
  Payload ID: 8716
  Gene Symbol: KLHL26
  Gene Name: kelch-like family member 26
  ENST ID: ENST00000599006
  CDS Start-End: 28-465
actcgaacgcgcgacggcggggggaagatggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggacgtagcccccaagacccccgggaccctggcctgaccgcatgttgtctccaagtggggcttggcgaatgcacgtctgcctgagaaccccagtgccccccttcgcccgggctgcccttgaggggcctgctgcgttgataagcccccctcccaggggtccctccctccctccttcccaaagcagatcctggctgcgagtccatccgagggagcctgccggcaaagcgtctgacatgtggtggcagcaaattcgtccccggggtggtttcctcgcctggcccccgagtccccacgggctggcgggtggaatcccaggtctccagggggtccctgtgcagctccatctcacttctctactgcctcccagccccacggtttcaggcattcagatgtgagctcatcaacattgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggagga

SEQ ID NO: 145310 - DNA, 522 bp, Homo sapiens
  Payload ID: 8716
  Gene Symbol: KLHL26
  Gene Name: kelch-like family member 26
  ENST ID: ENST00000595182
  CDS Start-End: 31-339
gtcactcgaacgcgcgacggcggggggaagatggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcaggctggagtgcagtgccagtggtctcgatctcctgatctcatgatccacccgcctgggcttcccaaagtgctgggattacaggcatgagccaccgcgcccggcccctttgcatgtttttaatgagcattccgcctactttcctcttgctggctgtgccctgtgttctgtgtccccaggctactgttccccaggccagatcattcctggctggccaaaacacccctca

SEQ ID NO: 145311 - DNA, 2177 bp, Homo sapiens
  Payload ID: 8717
  Gene Symbol: KLHL28
  Gene Name: kelch-like family member 28
  ENST ID: ENST00000355081
  CDS Start-End: 205-1962
attttaggcgaactgagaattttgtgtgcattttctcctcataagtgatacttaaacggacacagtggaagagctggagtgtctagtgtgagcctgaatgctttggagtgtggaagagatattttttttttttgaaggaataatactattacttttgaatgactcgtgcgaaaagtctaagttatcatttgaagacccaaatttatgcacttcaaatgcaagtattcctaccctgctctgtaccagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaagtttctcactagactatatgaagcaaatcatcttattcgtgatgatcgcacttgtaaacatcttttgaatgaagccctaaagtaccactttatgcctgaacatagactctctcatcagacagtcttgatgacacgacctcgctgtgctcccaaagtactttgtgcagtaggagggaaatctggactctttgcctgtttggatagtgtggagatgtactttcctcagaatgactcttggattggtttggcacccctaaacattcctcgctatgaatttggaatatgcgttttagaccaaaaagtatatgttataggtggtattgcaactaatgtgcgtcctggcgtcactatcagaaaacatgaaaattcagtggaatgctggaatcctgatacaaatacttggacttctctagagagaatgaatgaaagccgaagtactcttggagtagtagtacttgcaggagaactttatgccttaggtggttatgatggacaatcttatttacaatctgtagagaagtacattcccaaaataagaaaatggcaacctgtggcaccaatgacgacaacaagaagttgttttgctgcagcggtattggatggaatgatatatgccattggtgggtatggtcctgcccacatgaacagtgtggagcgttatgatccaagtaaggactcctgggagatggttgcatccatggcagataaaaggattcactttggcgtgggtgtcatgctaggctttatttttgtggtgggtggacataatggagtctcacatttgtccagcattgaaagatacgatcctcatcaaaatcagtggactgtgtgtagaccaatgaaagaacctagaacaggagttggtgctgctgtaatcgataactacctttatgtcgtcggtggtcactcagggtcttcctatctgaatacagtgcagaaatatgatcctatctcagatacgtggctggattcagctggcatgatatactgtcgctgcaactttgggttaactgcactttgacaaatgtgaactctcggaaatagtatggtggtgaaacttgtactgcatgaacatccggatggcccagttttctgaaacccacaagctgcattgctttctttttaacttgaagtagcatgaaggctcaaaagttttgttgggtacttttaattgagaagtagttttggttgctcttgattacacagtaaatcaataatcaaaaagaaaaaagagaa

SEQ ID NO: 145312 - DNA, 6545 bp, Homo sapiens
  Payload ID: 8717
  Gene Symbol: KLHL28
  Gene Name: kelch-like family member 28
  Uniprot ID: Q9NXS3
  ENST ID: ENST00000396128
  CDS Start-End: 121-1836
aagttgcccgccccacccgtaagagttagggtttgaccggagctagtgaggatccagcccaggctccagttgtccgcggttcctcctcctgtcgctgcccgtgtgattactgagactcagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaagtttctcactagactatatgaagcaaatcatcttattcgtgatgatcgcacttgtaaacatcttttgaatgaagccctaaagtaccactttatgcctgaacatagactctctcatcagacagtcttgatgacacgacctcgctgtgctcccaaagtactttgtgcagtaggagggaaatctggactctttgcctgtttggatagtgtggagatgtactttcctcagaatgactcttggattggtttggcacccctaaacattcctcgctatgaatttggaatatgcgttttagaccaaaaagtatatgttataggtggtattgcaactaatgtgcgtcctggcgtcactatcagaaaacatgaaaattcagtggaatgctggaatcctgatacaaatacttggacttctctagagagaatgaatgaaagccgaagtactcttggagtagtagtacttgcaggagaactttatgccttaggtggttatgatggacaatcttatttacaatctgtagagaagtacattcccaaaataagaaaatggcaacctgtggcaccaatgacgacaacaagaagttgttttgctgcagcggtattggatggaatgatatatgccattggtgggtatggtcctgcccacatgaacagtgtggagcgttatgatccaagtaaggactcctgggagatggttgcatccatggcagataaaaggattcactttggcgtgggtgtcatgctaggctttatttttgtggtgggtggacataatggagtctcacatttgtccagcattgaaagatacgatcctcatcaaaatcagtggactgtgtgtagaccaatgaaagaacctagaacaggagttggtgctgctgtaatcgataactacctttatgtcgtcggtggtcactcagggtcttcctatctgaatacagtgcagaaatatgatcctatctcagatacgtggctggattcagctggcatgatatactgtcgctgcaactttgggttaactgcactttgacaaatgtgaactctcggaaatagtatggtggtgaaacttgtactgcatgaacatccggatggcccagttttctgaaacccacaagctgcattgctttctttttaacttgaagtagcatgaaggctcaaaagttttgttgggtacttttaattgagaagtagttttggttgctcttgattacacagtaaatcaataatcaaaaagaaaaaagagaaaaaaaaaaagtaaagactttgccaattgaattctgcactttttcccccaagactgagatgtactagttttatgttcataagtgtacatgtagacaaaacgtggctgctttttttttttttttttttttattttagctctccttccctgataaccatgattttctaggatgagcgatgctttaggtgctggagtgtattgaatgaatggacagagtgctgatactgcttcttggatgtaaatgcttcacatttttcatttgttttaaaacaaacaaagggctgctttttattttggtacttttaaaggttgtaaataacatgccaataggtagtcatctgaatactttcctgctaaatggttttagggctacggatgtaataaatttttaagacaattgcttttattatcatgatatttggggccctattttaggaaatcagatatttactgtttatgccttttgtatatgggcaggttaacgttggatgaatttaattacctatctatgctatggttagcatggataggagtttaagcatatcaggtgtttcagtttttcttcagtagtacagcaggcctcccagtgctgatgtaaatatttgagcagtgtttagtaccattcttagtgcatattaatttttttatatatccttataattttagttttttaagatctttgctttttcaaagtgttcagatataaaatggtgctaactgtaggatttataacaaggctataactgatgtccttttggatgttcagtatgagatatgcatgacatgttttgatagtcttttgcatttttaatggcttgattcatttgtgcttattaaaaatgttagtgattacgccaatgttaacatccaaaaatcatcagaatggcctgtgttatgcttttcatggttcctgaatagtgatttaaagaaagttacacttttgatcttctttcttcttgtgctagatattacatgtctttcttaaaaacagaaatatatgcattaaatataaagcactaggcagttatgcattactttgtacatttcttaggtaactgaatattttaaggttattgaggaaaactggaactcgatgtttacttgagtaatagttctaagttgagttctactttgattaaagaaatgatcttttaaagcaaaattgtttgctgtagccagtgacagcttatttaaagaaagtgtttaacttatttgattttagcatgttttagtaaatgtctgttagtcttaaacacattcacttgcattttattattatgtcggtacttgtattttggaactgtagtcatttgattttcttttccttgattttttttaaacctgtttgcgatctccttataaagtctctgcaagataatttttcttaagaaaaaaattcatattatattcttaagtgccataatgttctagactattgttaagaagccatttgtaattataaaacataggttcatttgttagtatatatgtttatttcttgaatactatagccgggcaatttacagttctttgttcttccataaactgccagttgtagatttgaatatatactacaaaactatgtaaaatcatttttaatcataaatgtagtatcatgctttatgaatatttgcacagattataaaaccttgcaagtgatttttagtctcttctaatttagaactcaacaggagcaactaataacaattgatagtctgagtattttctatgttgcttgtctgaataacataataatatatagcaataactttttcattgatttgaataaatctattgcatagaaataggtgcactattgtagttggcccagactttatttaaagaaaagcagtttaaaatagattcatcacatatttagttttaaatccccaattcagttttctttgtttatagcaatcaaattattaaatatatcctattatactatttttaatcccctattcccaaaagataagggaatttgaaagactgtggaaaatgattttaggacgggcgcagtggctcacgcctgtaatcccagcacttggagaggccaaggcgggtatatcacctgaggtcaggagttcgagaccagcctggccaacatggtgaaaccccgtctctactaaaaatacaaaaaattagctgggcattgtggcaggtacctgtaatcccagctacttgggaggctgaggcaggagaatcacttgaacccaggaggcagaggttgcagtgagccgagcttgcaccattgcactccagcctgggcaacaagagtgaaactccacctcaaaaaaaaaaaaagattttaattataaacacatctattctatacattgtattttaacaatattttactcatgtatcatctccactatcaaattagtgtataatcatttggtaaattagatcaaaaacatatactggtcattgtttttgaaaaatctaaatttcatcttgatgaagactaaatgtgaaatatcttgggcagtagtagtaggagccatacaccagtgaacaaattatgaaaatctgtgaaaggaagaggaaaaatgttcaaaatttagaagtatatttattttaggattgcttaacctactgtattattcgtaacaaccagagctactaatctgacctgacaactaatatgtttacattagcgccttcttttacaaatttgtgagaagtttcattatgaacactctgctgacaaattgtgaatttaaagccacatgtttctatgttaaaaaggatcaaaatgtttggttataaatcctcaggattaaaagtattagaaataattttacatattcaggcaagaagagaaaagctatttaagatttcccagaaatattttggaaaagagcagcactgggaaatagaaattaatgtaatcagttgcaagatacttgccttctataattataacaacttaatctgttaggcacctttggctattcaataatcattggatgttgtaatagaatgtaagtggcttttaatgtagctccaaggatatttataaattgtgttattgctgttattgttttaaatgtgagtgaatattaaattataggaagtggtatcaagtgataggaaaatggcattaggttttgaaattttattttgataatttaacacatatggagggtttgctatatgtatgagatattctgttagatgctgtgggagctagagagatatactctttttcactcaaagagagtaaaatatagtgggagagaccctaataactattttggtgaaggatgaatctaattccttatctctgacatcgtaagaagtgattagagacctagtttatgcataagcaattccttagtgtccaattaggttttattggcatgaaaaagaaatattaaaaaacctaatatttatagaactccaaatctcctagaattggataatgtattttctagtaagaaaactatagaaattttaaatatatatatttcctgtagtatcaagactctggctgacattgagagaaatatatgtacatgttgtgtttattttcagttttggtgttggattcctggtattgtcacctaagtgctcattttcaggaaaatcagattctacaataaacacttactgcttaaagttcagtaaacttgtgataacctcataacctctgtagtctaaaagttaaggaattataagatgtcacatgtcaagttaacatccagttctacttcttaaccttttttccctttgtaaacagcactttaattagacatgatttaattagataacaattattccatggctggatatgtactggattttcacttacagtacattgatttggtgttgatacacatttgaaaagagtgaggaatacaatacatttttaatacaataggtttacaaattttcctactggtgtgaatatggagtcaaataaaaatccagtttacatctctgcagagagaaaaattgttatccatatgtcttttatattatacatctttactagagataacttattgttaattttgtcaagttatgtgtaagtcccatttatttttaaatactaagcaaaaagttccaagtttgccttaaaatacaagtgaagttaaagaactggatgataatgcctatatttttgccttatgaattgtgctgtgtattataaaccagcaacggttttgattttaacaggattctgaaattttgtagctgtagagtactaatatttgtactctcttgcaaagaatgtgatctagttgtggattatgttagtttaaatgtttttgtatatgtattttacctctgaacatgtacctttttagcatcagggttttattttatttatgtttacacactaaagtgtcatttaactagttaagaattgtattcttttttattttaaaggttatttgtgtgtatcattgtggtaatgttctgtaattattatggttaaatttcatttaatgtaaaatgtttaaaataaaaatgaaaaatctactttg

SEQ ID NO: 145313 - DNA, 656 bp, Homo sapiens
  Payload ID: 8717
  Gene Symbol: KLHL28
  Gene Name: kelch-like family member 28
  ENST ID: ENST00000557468
  CDS Start-End: 520-656
tgaccaaaccgattgcttccatggtgatgtacccagcgcggacctcttgacccggaaatccacttgccgtgatgaatgctgggttatgtagtccacgtcaggtgttgagactaggccaaagtctcctggaagaggaagtcagaacgttgtaaacgcagctacagcggagaagggaggaggggtgaagccatttgacggatgtgacgctttccttgctctgggcggaagttgcccgccccacccgtaagagttagggtttgaccggagctagtgaggatccagcccaggctccagttgtccgcggttcctcctcctgtcgctgcccgtgtgattactgagactcagacatccaggaatattgaacgtcagtgtgaattctgtaaactattaagaattttgtgtagtttgagaagttattgtgaagaaatgctatgcaaatgaaagttgctattaatattaacaaacaatcataataataccatgttttgagtatttgctatgtgccatgcaccatgctagatggaccacacatccccgacctacatgcttgctaacttaacccacttgcattctgaacaacttctgcagggcttgaatcttcttcgccaacatcacgaactctgtgacatcattcttcgagtaggtgatgttaaaat

SEQ ID NO: 145314 - DNA, 859 bp, Homo sapiens
  Payload ID: 8717
  Gene Symbol: KLHL28
  Gene Name: kelch-like family member 28
  ENST ID: ENST00000556500
  CDS Start-End: 372-859
ggaagttgcccgccccacccgtaagagttagggtttgaccggagctagtgaggatccagcccaggctccagttgtccgcggttcctcctcctgtcgctgcccgtgtgattactgagactcaggtattttccttttgctgtcctccagcggtgcaggctttggcagtgttttgcccgaatgccactggtgctagagtaagaggcaaaggactgagcggagcaggtggaaagagaggcgacatcttcttgtgcagggctcgtcacccttgtaaacgcgttactctctaccaccctgagtaactgcgatcctttcctcttgccatctgcttatcaggacagaagatctggaccacggccaagctcacaaatcggatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaa

SEQ ID NO: 145315 - DNA, 546 bp, Homo sapiens
  Payload ID: 8717
  Gene Symbol: KLHL28
  Gene Name: kelch-like family member 28
  ENST ID: ENST00000556239
  CDS Start-End: 295-546
agtgttccagagagctaccaaagtgctttctgtgaggaagtcccatggtctggtttatatcttaacagcatcaatggctgttatatgagatggagtaataatgcaagcatggaaaccggtgatgaaactacaatagccatgtgggagataattacggcatgaactagagggatggcagcagagactgcagtagccaactgtcctttgtaatctgctccaccttttttggagggcacagtggaatttgggaggagaggagaaaactaactatacctcgtattttgctccaatgagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaact

SEQ ID NO: 145316 - DNA, 847 bp, Homo sapiens
  Payload ID: 8717
  Gene Symbol: KLHL28
  Gene Name: kelch-like family member 28
  ENST ID: ENST00000579157
  CDS Start-End: 152-847
gcccaggctccagttgtccgcggttcctcctcctgtcgctgcccgtgtgattactgagactcagttatggaggctgagaagtccaaggtcaagggggccacacctggtgtgagctttcttggggctgcatctggtggaagccttcttgctgatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaag

SEQ ID NO: 145317 - DNA, 3043 bp, Homo sapiens
  Payload ID: 8718
  Gene Symbol: KLHL29
  Gene Name: kelch-like family member 29
  ENST ID: ENST00000288548
  CDS Start-End: 1-1628
cacactcctatggagtggcccagcctcccaccttcagcccggctgtgaacgtccaggccccggtcattggggtgaccccctcactgcctccccacgtggggccccagctcccgctgatgccaggccactactcgctccctcagccgccctctcagccactgagcagcgtggtggtcaacatgcctgcccaggccctgtatgccagccctcagcccctggccgtgtccacactgcccggtgtggggcaggtggcccgcccaggacccaccgctgtgggcaacggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagagaaatgttgaaggaattgaaccagcaacgcagagcgaaagcgtttacagacctgaaaattgttgttgaaggcagagagtttgaagtccaccaaaatgttctagcttcctgcagcttgtatttcaaggacctgattcaaaggtccgtgcaagacagcggccagggcggccgggagaagctggagctcgtcctgtcgaacctgcaggcagacgtcctggagttgctgctggagtttgtctacacgggctccctggtcatcgactcggccaacgccaagacactgctggaggcggccagcaagttccagttccacaccttctgcaaagtctgcgtgtcctttctcgagaagcagctgacggccagcaactgcctgggcgtgctggccatggccgaggccatgcagtgcagcgagctctaccacatggccaaggccttcgcgctgcagatcttccccgaggtggccgcccaggaggagatcctcagcatctccaaggacgacttcatcgcctacgtctccaacgacagcctcaacaccaaggctgaggagctggtgtacgagacagtcatcaagtggatcaagaaggaccccgcgacacgcacacagtacgcggctgagctcctggccgtggtccgcctccccttcatccaccccagctacctgctcaatgtggttgacaatgaagagctgatcaagtcatcagaagcctgccgggacctggtgaacgaggccaaacgctaccatatgctgccccacgcccgccaggagatgcagacgccccgaacccggccgcgcctctctgcaggtgtggctgaggtcatcgtcttggttgggggccgtcagatggtggggatgacccagcgctcgctggtggccgtcacctgctggaacccgcagaacaacaagtggtaccccttggcctcgctgcccttctatgaccgcgagttcttcagtgtagtgagtgcaggggacaacatctacctctcaggtgggatggaatcaggggtgacgctggctgatgtctggtgctacatgtccctgcttgataactggaacctcgtctccagaatgacagtcccccgctgtcggcacaatagcctcgtctacgatgggaagatttacaccctcgggggacttggcgtggcaggcaacgtggaccacgtggagaggtaatgaggccacggtcaggacaggggcatgctctttgctcaccaagaactgaaatcacgtcactcactgtacctcccaacacccactcagtggcgatggagcagagcctggaccattcatatgggcagtcatcccaggctcttcagtcacagcaccgggggcagcagggtgtgggatacaagcagatgggatgacatctgtgtcacctttgcagtcgctgagatgggagatggggcgcttctgtcccgacaacccatttaggtgtcagacaagctggaggcccaagatccagttgcagaaggcctgggatgagccagaccctcctggccaggcagtcagggaacaccctgcaccatgagcaccagcccagagactgctggggtttcgggcaaagctggaagcaatgtttaaaatgcaggtcatgccagtggcggtgcctccttgtcctgccaagcggggggtcccacaccagggagctcccttcctccctccagccacacacaccaggacatctgttcgtaatacagagaaaggccactgcatacaaactaagcaatttagggagaacattcttgccaaccctctagaactttccagaagaaaaaataagccaaaggaccacgtgtgaacctgccctccgctgggagtcccagcctggcttcctcccaaggccattgtggagggtcagatacaggcatgaggggcgtgggctgaagtgggtgcttccggatgagaatacaaaatccttttcccttgagccagggagactgttctttcttacagagaacagatgcctgggggaaaagctcaggaagctttgtcaggcagcagaacggaggcttagtcctgcttttggagaaactagtgcctggagggtaacccgtcaggctgacctggcccaaagcacaacccaggggagacagctaagattgccagagcccctcctgcacctgagcccaccacccccaccgccatgtgtcaccagaaagcacatcttcccgtgggacatcatgttgcctatgaagccacacatacccctcaatttgtatttttcccccttggtggctaattggacacttgacaaatgttacagcaaagacggttgcagagtgaggcaggctctgaatgctcattgtgggcttttaactcctcccccaagtagagcccagagatggctcagtaacaacatttagttatcatattgatctggcaatcatgggcattgccacgtgaaaatgaggatattaccgcagttgctggagctgggttggccccggtgctggcagccttcagtgtgacccactgcccagctatgcataccccaagcattctggaagcatcggcttccgatcatttgtcatccaataataaacaaacacatgaaaaatgagacattttctctgtaggagtaaactgaa

SEQ ID NO: 145318 - DNA, 5287 bp, Homo sapiens
  Payload ID: 8718
  Gene Symbol: KLHL29
  Gene Name: kelch-like family member 29
  Uniprot ID: Q96CT2
  ENST ID: ENST00000486442
  CDS Start-End: 718-3345
ggtccccgcgccgcggccgcgccagcccccgcgccgccgccgccgtccccgccaccgcggatctcgccgcagctccagccccggccccggctccgcagcgcccgtccgcagccccggcggtcgccgcgcttgagcgcagcccccgcccggagcccgagccgcgagcccggagccagccccagccccgcggccgccgcggctgcggggagagggcgggggcgatgctgccggagccgccgccgccgccgccgcctcgatgagagccgcgccgcaccgctcatagccgcacaggctgacaggcaggaggaccgacttccctctcccgggcatcctccctgggctgccgggaggcggcggcggcggaggaggaggaggaacgaggggagaaggcggagagcaggaacgcgaggaggaggacctggatccgtttcctccggccaggacccgagcggccccagccaccgctacccgccggcgctgtccgctctccatcagccctcctgcgcccacccgcgaccccgggctctctgcgcgtcgggccggggccggagccgcgcgccggagactatctggcttcctggtgatgctcacgctttgctaagtgttggcggccatcgtggttttcgcatcctggggacgaatcctgagcttgccagagacgggcggcgcaaggtccgggctctgtttccctgtgagaagccgcctcggcccaccgagatgtcccggcaccatagccgcttcgaaagagattaccgggtgggctgggaccgccgcgaatggagcgtcaacgggacgcatgggaccaccagcatctgcagtgtcacctcgggggccggtggcggcacagccagcagcctcagcgtccggcccggcctcctgccgctgcccgtggtgccctcccggctgcccaccccggctacagctcctgctccctgcaccaccggcagcagcgaggccatcaccagcctcgtggccagctctgcgtctgcggtcaccaccaaggctcccggcatctccaaaggggacagtcagtcccagggactggcgaccagcatccggtgggggcagacgcctatcaatcagtccacaccctgggacactgatgagccaccctccaaacagatgagagagagtgacaatccaggcacagggccatgggtgaccacggtggccgccgggaaccagcccaccctgattgcacactcctatggagtggcccagcctcccaccttcagcccggctgtgaacgtccaggccccggtcattggggtgaccccctcactgcctccccacgtggggccccagctcccgctgatgccaggccactactcgctccctcagccgccctctcagccactgagcagcgtggtggtcaacatgcctgcccaggccctgtatgccagccctcagcccctggccgtgtccacactgcccggtgtggggcaggtggcccgcccaggacccaccgctgtgggcaacggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagagaaatgttgaaggaattgaaccagcaacgcagagcgaaagcgtttacagacctgaaaattgttgttgaaggcagagagtttgaagtccaccaaaatgttctagcttcctgcagcttgtatttcaaggacctgattcaaaggtccgtgcaagacagcggccagggcggccgggagaagctggagctcgtcctgtcgaacctgcaggcagacgtcctggagttgctgctggagtttgtctacacgggctccctggtcatcgactcggccaacgccaagacactgctggaggcggccagcaagttccagttccacaccttctgcaaagtctgcgtgtcctttctcgagaagcagctgacggccagcaactgcctgggcgtgctggccatggccgaggccatgcagtgcagcgagctctaccacatggccaaggccttcgcgctgcagatcttccccgaggtggccgcccaggaggagatcctcagcatctccaaggacgacttcatcgcctacgtctccaacgacagcctcaacaccaaggctgaggagctggtgtacgagacagtcatcaagtggatcaagaaggaccccgcgacacgcacacagtacgcggctgagctcctggccgtggtccgcctccccttcatccaccccagctacctgctcaatgtggttgacaatgaagagctgatcaagtcatcagaagcctgccgggacctggtgaacgaggccaaacgctaccatatgctgccccacgcccgccaggagatgcagacgccccgaacccggccgcgcctctctgcaggtgtggctgaggtcatcgtcttggttgggggccgtcagatggtggggatgacccagcgctcgctggtggccgtcacctgctggaacccgcagaacaacaagtggtaccccttggcctcgctgcccttctatgaccgcgagttcttcagtgtagtgagtgcaggggacaacatctacctctcaggtgggatggaatcaggggtgacgctggctgatgtctggtgctacatgtccctgcttgataactggaacctcgtctccagaatgacagtcccccgctgtcggcacaatagcctcgtctacgatgggaagatttacaccctcgggggacttggcgtggcaggcaacgtggaccacgtggagaggtacgacaccatcaccaaccaatgggaggcggtggcccctctgcccaaggcagtacactctgctgcagccacagtgtgtggcggcaagatctacgtgtttggtggggtgaacgaggcaggccgagctgccggcgtcctccagtcttacgttcctcagaccaacacgtggagcttcatcgagtccccaatgattgacaacaagtatgcccccgctgtcacgctcaatggcttcgttttcatcctgggcggggcttatgccagagctaccaccatctacgaccctgagaaaggaaacattaaggcgggcccaaacatgaaccactctcgccagttctgcagtgctgtggtgcttgatggcaagatttatgcaactggaggtattgtcagcagtgaagggcccgcgctgggcaacatggaggcctacgagcccacaaccaacacatggaccctcctcccccacatgccctgccctgtgttcagacacggctgcgtcgtgataaagaaatatattcaaagcggctgacatcagcagaaagcccacgataagactgtggacaagtctggtgaggcaagtgccacgcaatgataattttccagcgacaccaacaagaggccaacaaaacacaatcaaggaactcactgcgctcaacatgttgaatattctctacattgaatgtagaaaatcatcctcgcctttggatgaaacggaggcaccgcgcttggagccgcaggaaccacgatcccgccatggggctggctgcctcctgaacaggggcgctcgctctgccaggtgcaatagagtttcacgtatttttcaactgggagagagaagctgttttttccttcctgcagagcaagcttgatccctaaacaaccatagatcagttatcttatgacaacattaggcatcaggctctcttggaataagatcaaagtgtccttatcactttgattcctacttttgttttttaaccgatctacactttcagtggccgacagaaaacgagggacaatactgtgcatcacaaggcctaggaggctgctggtccccactggggctgaagagaagcccagctgcccacgcggagccaggggtggcagctgtgggacagccggggagcagggacagcggtctgtccttcacaggtttttctactgtgtttttgctggagaaggacagtgattgcgctagctttctcttacccggtatgaattatttagatttctgaggcattttcttgataaacaaaaggctatttttaagtactgagaggaggagcaggccacaagagggataatgttgtgggaattcccaaagctctttgtaggtagtgccagaggggggcttttgctctcatttttctatgtgcagaatagaggatctctcctggggtgggcgatgcccccattttatttttagaaaaagtaactcccagacagccccataaaagctgtgcccaaggaagaagagtctgctctagaaggagcccggttctggctcaggacaccggcccagctccctccatgaggtcaagctgaggaccaggccagtgggaagggaaggagggagaattagcgtctataaagcacaggagactatttttgatattcatagctatatattaaggcacctgccacaagagctctcaggatggggacagccttcttagtggagccatggcagcaaggcctgagggcatgaacagaaccactcttcttgtcacatacgaacctgagaaaagggaagccaggagggaggtcacaccatggctcaaaagggaaaggccttcccacttgtccttagcccctcaaacctcacacggtcaacagtttccattccagggcaggagaatgctgccgccactgcgctgttgagttgaagttggtaccaaatacacatttaccacttttatatctgggaagtcaacttgccatcgtttcatgataacaaccatttataagagaaaaagacaggacacgctttccatcgttcagtatttgatgacacaaaattccagttctaacgttgggcatcaacttctagcactacgagtgtggctcccacttggacaagataccgagcttcgttatgcagtttttaatattatttattattttaaaaagtaataagcacaaaactacatacattgtatgtcatttaaagtatttatgtcaaacagggtgcaagtgtgaacccaaggactggagcacaaattcctaactgcctggggcagggctaatgttagcattggtgtgcgtctgcctccaaaggaggttctagttgtcagcgagactcaacacagatgacattgaaattcgtttctctcctcatctatcacactggagcaaaactggctatttctgtgaatgatataaaacagggttctctgtaatggtattgtacatagtatatgtttactgttaagttcttgttatattataataaatatatttatagatctaga

SEQ ID NO: 145319 - DNA, 6806 bp, Homo sapiens
  Payload ID: 8719
  Gene Symbol: KLHL3
  Gene Name: kelch-like family member 3
  Uniprot ID: Q9UH77
  ENST ID: ENST00000309755
  CDS Start-End: 445-2208
gattctttgcagcctagacagaggaggcaggagccccaggggcgggctaatcgcctgggctggggatgcctgggcagatgcagaggaagctggaaaggtggcagtgcacctgggtcgctggagctgccgccgttcctaggagaccaaggagcagcaagcctgcgggggagggggagcaagtgggttgctgcttttagcagctgaaagggctgcagggagctctgggtaagacattttctgttgctgctgcttttgcggtagaagctgctgcgagtaagtcagaggaaggaggattgagaagggaggaggcttcacttgcagccatgctgaatcactgttgctgatcagatttcccactggtctgctgggagaatcaagaacagaactaggatccccgagtgcatacacagttcagcagctaccaccctggctgggcctcacacaatggagggtgaaagtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcggagcagtgtgggtgtgggcgttgtggaggggaagctatatgctgttgggggttatgatggagcttcccgccagtgtctgagcactgtggagcagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggccttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaatgtttgtatatttctgagccagatcctttcaaagattgcctttttataaaattgaagctatagcttttaggctaaaattttaacgtagatatttttataagatatttttttcaagagtttgaatcgctttttattgtccatgataatgaaatgttgtgttctttgcatcattcactctcaaacgtagttcatgcctgtagctctcttccttttgtttctcacccttcagaaacatatttttcagtagctccaggtagatgagccttttttttttttttaaaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccatcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 145320 - DNA, 6981 bp, Homo sapiens
  Payload ID: 8719
  Gene Symbol: KLHL3
  Gene Name: kelch-like family member 3
  Uniprot ID: Q9UH77
  ENST ID: ENST00000508657
  CDS Start-End: 716-2383
ctcttgtgctctcctctagttttactgaactgccagtactttgaacacactttgtgctttttctcctccaggtctttgtgcatactgtttcctctgcctggaatactcttctttctctttacctgactcgtttctgctcttacttcaagtctcagattctaggaagctttccatcaacctgctatcactgggacgagttggccatcccctgtgcttctgtagctcctatgaaatcataatagttgaaatgtgatgtttaaatgtttacttggcattctcctctactgaactctaagctttgtgagggtagtgatggtggctttgcctattgttttgtttcccttaaatctaaacgcagtgcctggcacatagtagcctccagtaaatgcttgtttaatgaacaaacaaacctgtgaagtgagtgatagagtgcttagtccccttcagttttcaggatggagagatggagaataaggacctcacacaaaatcacacagtacttggtggaagaagctgagctatgacctgccttccttcagaggaatgcactttgctttggaagatatgaagaaattcccagtacattgtctttcctattgggtctgtgtgagaacaggctgatagatgcctctgtgtcaagctgagctcccagactctgatacaggctggggatgatgagaagaaccagaggacgatcactgtcaaccctgcccacatggggaaagcattcaaggttatgaatgaactgcggagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcggagcagtgtgggtgtgggcgttgtggaggggaagctatatgctgttgggggttatgatggagcttcccgccagtgtctgagcactgtggagcagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggccttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaatgtttgtatatttctgagccagatcctttcaaagattgcctttttataaaattgaagctatagcttttaggctaaaattttaacgtagatatttttataagatatttttttcaagagtttgaatcgctttttattgtccatgataatgaaatgttgtgttctttgcatcattcactctcaaacgtagttcatgcctgtagctctcttccttttgtttctcacccttcagaaacatatttttcagtagctccaggtagatgagccttttttttttttttaaaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccatcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 145321 - DNA, 1566 bp, Homo sapiens
  Payload ID: 8719
  Gene Symbol: KLHL3
  Gene Name: kelch-like family member 3
  ENST ID: ENST00000504208
  CDS Start-End: 442-759
tatttttaaggcccattggctttgcctaaaccttggtaaacagatactaaaaatctccagtaacattgcaaaattttgttctaattatcaggttcagcttcaaaacgtgtaaaatgcattgtgtactgagagtaagaggctgactctcgttagatccatttctatcagtgtgtttaaagccaaaaggaaagtaaaatacacatggctttcttctgacttgagttgtgtgattatggtcttttactcaagcttaaatgtttttatttttttgtcttccgagttcatgttgcccaaatgtcctgaggtggttccaaataccaatcccacacttcttgaccattgtcctgtggacaataacttggaataaatgtgaaactgaagtctgagtgcccatcagagagtgtcccaatccaaccagtctataagaagatctggggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcag

SEQ ID NO: 145322 - DNA, 6566 bp, Homo sapiens
  Payload ID: 8719
  Gene Symbol: KLHL3
  Gene Name: kelch-like family member 3
  Uniprot ID: Q9UH77
  ENST ID: ENST00000506491
  CDS Start-End: 451-1968
agatttatatatttttaaggcccattggctttgcctaaaccttggtaaacagatactaaaaatctccagtaacattgcaaaattttgttctaattatcaggttcagcttcaaaacgtgtaaaatgcattgtgtactgagagtaagaggctgactctcgttagatccatttctatcagtgtgtttaaagccaaaaggaaagtaaaatacacatggctttcttctgacttgagttgtgtgattatggtcttttactcaagcttaaatgtttttatttttttgtcttccgagttcatgttgcccaaatgtcctgaggtggttccaaataccaatcccacacttcttgaccattgtcctgtggacaataacttggaataaatgtgaaactgaagtctgagtgcccatcagagagtgtcccaatccaaccagtctataagaagatctggggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcggagcagtgtgggtgtgggcgttgtggaggggaagctatatgctgttgggggttatgatggagcttcccgccagtgtctgagcactgtggagcagtacaacccagcgaccaatgaatggatatacgtggcggacatgagcacccgccgcagtggcgcaggggttggagtgcttagcggacagctgtacgccacaggtgggcatgatgggcctttggtgaggaagagcgttgaggtttacgatcctggaacaaatacctggaagcaagtggcagacatgaacatgtgccggcgcaacgcaggggtctgtgcagtaaatgggctcctgtatgtggttggaggggatgatggatcctgcaacttggcttcggtggagtactacaatcctgtcactgacaaatggacgctgcttccaacgaacatgagcacggggcggagctatgcaggtgttgccgtgattcacaagtccttgtgacccaaactcctactgccaggaggtggaggaaggagcaggtgctgcctgtgactctgaacagcaggaccttggtgactggattcaacttgcttgggagggtctgtgctgctgtgagaaccgctctcctctgacttggcagactggtgttgttcatcgcagtgtggacaccattacccacccccgttcccctgaggtgctctggcctatgccctgagcaaggggggtcttgacatccccaggcagcacctttgggctttgttttggtgtttctacagggacaatacagaccctggagtgtgtgtgtgtgtgtgtgtgtgtgtagaccatggtgtttctctatgtttctctaagttggggggtgagcgtgtgtgacagtctactggatttctttactactgatcctttcgctgtgttaaaaatcaagtcacagagacctctcttctggatttgtcccatggggaccctgagactactaaagctgctttcttctgaaggtccagttggacagtctgggaatgtccagaaataaccagtgagaggggcagttctctggccacacccacttatgtactttaactactgtgactttgtctgcagaagagctggaaaattctcgaagctgcaccgtgtcctctgtgtgctagaataagggacaaatgggttccctgtgcttctcagctcactgtttttccttgagttctcctacaggaagcagatgagaactgcccagtcttcaggtttaggccattggtctttgatgtcatagattccaggcctgggaggtgttatgtctcttcagctgggaaaactagctcttcagagaagcctcgggtaacactgaaaaacaaaacaaaacaaaacaaaaacaggaaaaaaacaaaaaaccaaagtggtaaggattcagttcctgcctataatggtctcagagagggtcctacttttaggttttcccaggacaggacagtccccatttatacttattatcccagtttaattattcacagcaccccattttactcagaagtgttctggtctggaggataaataagaggtcaccctcctccagacccaaagatagatttgtgcctgtgttggatggggtcgtgtgtgattcagatggacattggatggcttcaaaggaatataccactagagctggcccttggcactttgtgacagtggtcaagtctgtctaatgtccttgtcttctttttcttgtgctttccccctattccagggtgtgcaccctctccccaacccccaagaaccccactactgctttccctgtgaggtaggagatatcagtgggccttggatttgaggcttcctaagatgtgcttgcattttaaaaagggagcttggtgagagctttgctaattcacaggtaaaaattattaacaatagaacttcaagcatcttgaggagcgggcatttgagggggcatggagtaatttgtatttaaaaaaccttaaagttgtgctgttcctaaactagcaaattgctcatgctgaaatttctggcataagcaggggaagtcttgtgtctggagaatagtctcataccttgcagtctgggacaccctccctactttgagaatccacctacaggaagccaaggaactttataaatcctgatgttggacttctgatacgactgggctacttccaagcaggtgctgcaggagattggcatcccccagcccctgcagttagaaaccccgaagtcttcccagccagtgagccactttgtgtatttactgtatatttattgtgccctaaatgtgcaactctcctaaagacaaaacttctctttctgatgttaagcacatgttacttcaacaagatgcttggagaacaacaaggtacccagaatttttagaagccttcagaagaggctaaaatatccagctttgggggacctggaagaaatgtctccaaaggaagcaaggcatgttttagttgagtgctctggtctcactatgaagtggggatgactgtggcttcataactctacctggctgtgggttggaagctgatggaatgagaaatgtcctttctccttctctgaggaaattttgagacttgtttcggtgtgtctgtgtgatggggatgaggctggggttgggatctgatgtatgccattcacagaagctctcaatttcagatgataggtgaattccctgcccctcccccaccactgagaagctagactttcatgcgggagaggctacttttatgtgtcgtcttccggggaagggtccctccactgaaagctagccagtcatgttttctgtttttggatttttgcaattggtttcacctcatgtctccctccctacaaagcactgcctctactgggcgtgctgccaaggccatgtgcactccatcctcatgtatcctttttcacggggaccagaacactggtacgtcatcaccaaagccaatctgctctagctgcccacagatgccaccaaaacctgctatctcttcatcaccaggtacgattctctttccacagtggacacagcaggctattttctagtttgtgctggtcacgtggtagatgaagcctcttactgccccacttagggtggccacggctgcttgtgaatgcagctttgccagtggcatatctgtcatctgattgcggtggtgaaatggaattgaggcccaaggttagaagcagccgagacgccacttggatactgatttgaacaatgtagaagtcagattctgaattccaaagttatttctcataagtacccaatggcatctctccatctacaaagttgcagtattatgcaaataaaactgacctcattttctgctatgcaataagaatacttaattctagttcccgacaagccagttgcaatatcccctaagatgctttttgagctgtcttactttgatatctgttgtgtaatgtttgtatatttctgagccagatcctttcaaagattgcctttttataaaattgaagctatagcttttaggctaaaattttaacgtagatatttttataagatatttttttcaagagtttgaatcgctttttattgtccatgataatgaaatgttgtgttctttgcatcattcactctcaaacgtagttcatgcctgtagctctcttccttttgtttctcacccttcagaaacatatttttcagtagctccaggtagatgagccttttttttttttttaaaaataccatattcaagggagtctgctgaattttaaaacgcagtcactggtgtttcttgaattgctagggactgatgttatgttcgactcagcacttgcccgtctgtattgattgtgtctttttttttttttttggagtctgctttctgtgggggtgaggccgggctgtctcgtggtggctcccactgacgggcactgagcctggtaccctgtggcatggagaagcctcagggaaaggcctgcccccccagcacatactcccatagtgtcctaggtccagccgaccattccttattctcttctatctccttgttgatctgaagcttccaatagcttgaggcctttgctgctggatgatgccctttttgggagcatcttgtctctaacctttaaaagaggggtcaatcctcatgatccctgtgtgttaagcatatgctttgcaggtgctcacactacacttacaacttgcttcttgagctatgtctctactccaggctctgttttgtgtatttatctgccatttgcatcatggtttttaaaatttattattattattattattgttgggacaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcatttgcagcatcaaatcaccctagtgccatgtttggttatgagattgtaaattattcgctcccccatcctcccctcccctcattttcagtggcaatagaggacccttgttgtacttcttgtttaatttgcatattatgtgtaaaatgctttcgttgaaagaaaactgaagacactgaatgtgtatgtctgtgtgggtgctctgtccctgtggttgtcatagccagtcagacttgatcactgacaccccgtacaacatattgcataggtaagatcctcgatctggtgttctctgcgtggctgttagggactgtatatcttgtaaaagaacacttgtcacatgcttgatcagttacagcaatagctgaagaaacatttcctcaaatgtattattttaacaggaatcatgttctaatttcccatcctttaattttaataaaagctgaactgtgtgaa

SEQ ID NO: 145323 - DNA, 1570 bp, Homo sapiens
  Payload ID: 8719
  Gene Symbol: KLHL3
  Gene Name: kelch-like family member 3
  ENST ID: ENST00000505853
  CDS Start-End: 370-1570
agatgcagaggaagctggaaaggtggcagtgcacctgggtcgctggagctgccgccgttcctaggagaccaaggagcagcaagcctgcgggggagggggagcaagtgggttgctgcttttagcagctgaaagggctgcagggagctctgggtaagacattttctgttgctgctgcttttgcggtagaagctgctgcgagtaagtcagaggaaggaggattgagaagggaggaggcttcacttgcagccatgctgaatcactgttgctgatcagatttcccactggtctgctgggagaatcaagaacagaactaggatccccgagtgcatacacagttcagcagctaccaccctggctgggcctcacacaatggagggtgaaagtaaacagctgttgtgtgacgtgatgattgtggcagaagatgtcgagatagaagcccaccgtgtggtcctggcagcctgcagcccctacttctgtgcgatgttcacaggtgacatgtctgagagtaaagccaaaaagatagaaatcaaggacgtggatgggcagacgctgagtaagctgattgactacatctatactgctgaaatcgaggtgactgaagagaatgtccaggtgctgctcccggcagccagcttgctgcagctcatggatgttcggcagaactgctgtgacttcctgcagtctcagttgcatcccaccaattgcctgggcatccgtgcatttgcagatgtacacacctgcactgaccttctgcagcaggccaatgcctacgcagagcagcactttccagaggtgatgctaggagaagaatttcttagcctgagtctggaccaggtgtgcagcttgatatccagcgacaagctgaccgtttcttcagaagagaaggtgtttgaagctgtgatctcatggatcaattatgagaaagaaacccgtttagagcacatggcaaagctgatggaacatgtccgacttcctctcttacctagggactacctagtccaaacggttgaagaagaagctttgataaagaataacaacacctgtaaagacttcctcattgaggccatgaaataccatctcctccctctggatcagagactattgattaagaacccaaggaccaagcccaggactccagtcagccttcccaaggtcatgattgtggttggcggccaggcacccaaggcaatccgcagtgtggagtgctatgatttcgaggaggaccggtgggatcagattgctgagcttccttccagaagatgcagagcaggtgtggtgttcatggctggccacgtgtatgccgtgggagggtttaatggctcactgcgggtgcggacagtggatgtgtatgacggcgtgaaggaccagtggacgtccattgccagcatgcaggagcgccggagcacactgggcgcagcggtgctcaatgacttgctctacgcagtgggaggctttgatggcagtactggcctagcatcggtggaagcctacagctacaagaccaacgagtggttctttgtggccccgatgaacacgcggcggagcagtgtgggtgtgggcgttgtggagg

SEQ ID NO: 145324 - DNA, 3726 bp, Homo sapiens
  Payload ID: 8720
  Gene Symbol: KLHL30
  Gene Name: kelch-like family member 30
  Uniprot ID: Q0D2K2
  ENST ID: ENST00000409223
  CDS Start-End: 108-1844
ctgtgttctcagcttcgaggtccaggctgagtgagaggagctcgggcggctccaggcacttcttcccttgagtgggtggactactgaggtcccctgggcacggcgtcatggtgcggaacgtggatgacctggatttccacctgccctcgcatgcccaggacatgctggatggcctgcagcgcctgcgctctcagcccaagctggccgacgtcacactgctggtgggcggccgggagctgccatgccaccgcggcctcctggcgctcagcagcccctacttccatgccatgtttgcgggtgacttcgccgagagcttctctgcgcgcgtggagctgcgggacgtggagcccgccgtggtgggacaactggtggacttcgtgtacacaggccggctgaccatcacgcagggcaacgtggaggcgctgacacgcacggctgcgcgcctgcacttcccctcggtgcagaaggtctgcggccgctacctgcagcagcaactggatgccgccaactgcctgggcatctgtgagttcggggagcagcaagggctgctgggcgtggctgccaaggcctgggccttcctgcgagagaactttgaggctgtggcacgtgaggacgagttcctgcagcttccccgagagcggctggtcacttgtctggccggcgacctgctgcaggtacagccggagcaaagccgactcgaggccctgatgcgctgggtgcgccatgacccgcaggcccgggccgcccacctgcccgagctgctcagcctagtgcacctggacgccgtgcccaggccctgcgtgcagcaactgctggcctcagagcccctgatccaggagtcagaggcatgccgggcagccctgtcccagggccatgatggggcaccactcgccctccagcagaagctggaggaggtcctggtggtggtgggcgggcaggcgctggaggaggaggaggcaggtgaggagcccacccccggccttgggaactttgccttctacaacagcaaggccaagaggtggatggcacttccagacttccccgactatcacaagtggggtttctccctggcggccctgaacaacaacatctatgtcacaggtggctctcggggcacaaagacagacacctggtcaaccacccaggcctggtgcttccccctgaaggaggcctcctggaagcccgtggcgcccatgctgaagccccgcaccaaccacgccagcgcggccctcaatggggagatctacgttatcggcggcaccaccctggacgtggtggaggtggagagctatgacccctacacggacagctggacgcccgtcagcccggccctcaaatacgtcagcaacttctcggctgccggctgccggggccggctctacctggtgggctccagcgcctgcaagtacaacgccctggccctgcagtgctacaaccctgtcacagatgcgtggagtgtgatcgcctcgcccttcctgcccaagtacctgtcctcgcctcgctgtgctgcactgcacggggagctctacctcattggggacaacaccaagaaggtctacgtgtacgaccccggggccaacctgtggcagaaggtgcagtcacagcacagcctgcatgagaatggcgcgctggtgccactgggtgatgcgctgtacgtgacgggcggccgctggcagggcatggaaggtgactaccacgtggagatggaggcctacgacacggttcgggacacctggacccgccacggcgccctgccccggctctggctctaccacggggcctccaccgtcttcctggatgtctccaagtggacccagccctccggccccacccaggagcactaaaccagggccagggtccccggggaggagtccccacagcggcccctcatcagcctgtggaacggcccctttcattttcgcttatttgttcactcggagctaccattccttccaagctgcgctcaggccaccaggggtgatcagacggcatggcttggaggacacagccttggtctctgtggccaccacactaaactctgagctgagcagtgacaagggcctgagtgccagacgctggcataacagggacaggaagctctgctgcccctggggttcccgagacctcagagaggggagccgggggccgggccagcattcccagagcttgcgagccccactcctgcccctggaccccagcaggggcttttggagcagttgcatgaatgtggggtgaacacggagcgtcccagaaagctgaggctgctggggaaggcaggccccggagatgggatcagcaccaggtcctcgtgggcctgcttctgcccagctcacggcagcgtaactgtggccagccacctcccctctctgggcttcaagctccgcgtccaccacacacggggctggctgtgtgggctttgggtccccactcaggctttgcatgttggtgctgtgtttctgcttctgtggacaaaggaggcccccacccatctcttgcacccagagggcggtgcccacagaggcaccaggaaggagggaggcagggcgtggggcggggctggagggtcccagggaggtgagcagttttgctctcagaagggattgcctccgtctctgtgtgtcagaacaaaggctcttcattagaatggaatttcccaccaggggacgactcttgggtgcattggtggcagcctcctgagggtgaggggtagcatccgatgggcccctgccagcatgcagcccgactccggctggctcaggctccgagtggcttctccctcatcctgaatgaggcacccacctttgcagctaaggagacaatgaaggactctccctgggtgcccaatggcgtgtccctcctgtcacaggctccgccctgggacatggggctagaagtcaggagtcgggcccggccaggcacaggccctggtgttgccccagaggccctgggcagctccggtctcccgccggatccaggcttcctctccaggaccagcccctgggttcctccttaacaccccccgcccctggggaccagaggggcctctgacatccttgggttctgaggacggaaacccctgagcctcttgagcttctgtaggtagggatctgctttgctcccagacctgcctctcatagcttttttttttttttttttttttttttgagacggagtctcgctcttgtcgtccaggctggagtgcaatgctgagatcttggctcactgcaacctccacctcccgggttcaagagattctcctgccttagcctctcaagtagctgggattacaggcactcgccaccacgcctgactaatttttgtatttttagtagaaacagggtttcaccatgttgaccaggctggtcttgaactcctgacctcaggtgatccgcccgcctcagcctcccaaagtgctgggattacaaggtgtgggagaagtgagttgaccctggagggccagacagagtggggcctctgggtgctaccaaaggaacaagagcccagagctgaggagaccttcggtggcagatggattggatgaagcaagggtgagggtttctggggccctgggctctgtttccatgtggaaatctgaaatgttttctagacagtgatggaaggaggtcagccaaagggctgtttaaaaacaaagcctccatgtaaaccatttctgcaagaatattttaaaataaataaaaataaaactgaagacatgaaatgtcaaaa

SEQ ID NO: 145325 - DNA, 5743 bp, Homo sapiens
  Payload ID: 8721
  Gene Symbol: KLHL31
  Gene Name: kelch-like family member 31
  Uniprot ID: Q9H511
  ENST ID: ENST00000370905
  CDS Start-End: 142-2046
accggattttccttctccctctctctatctccacagatcccttcccaagaggagtctcctgctaaaacttcatcatctcaagttgacctgccacttcacccaaggaggcaagctcttgcctgtaacagtgtatttgccaacatggcacccaaaaagaagattgtcaaaaagaacaaaggagatatcaatgagatgactataatcgtagaagatagccccctaaacaaactgaatgctttgaatgggctcctagagggaggcaatggccttagctgcatttcttctgaactaacagatgcttcttatggccccaacctcttggaaggtttaagtaaaatgcggcaggagaacttcctatgtgacttagtcattggtaccaaaaccaaatcctttgatgttcataagtcagtcatggcttcatgcagtgagtatttttacaacatcctaaaaaaagacccgtcaattcagagggtggatctcaatgatatctcaccactaggcctggccactgtcattgcatatgcctacactggaaagctcactctctccttgtatacaataggaagcattatttctgctgctgtttatcttcagatccatactcttgtaaagatgtgcagtgattttctgatacgggagatgagtgttgagaattgcatgtatgttgttaatattgctgaaacatactccctaaaaaatgcaaaagcagcagcccagaaatttattcgggataacttccttgaatttgcagaatcggatcagtttatgaaacttacatttgaacaaattaatgaacttcttatagatgatgacttacagttgccttctgagatagtagcattccagattgcaatgaaatggttagaatttgaccaaaagagagtaaaatacgctgcagatcttttgagcaatattcgctttggtaccatctctgcacaagacctggtcaattatgttcaatccgtaccaagaatgatgcaagatgctgattgtcacagacttctcgtagatgctatgaactaccacttgcttccatatcatcaaaacacattgcaatctaggcgaacaagaatccgaggtggctgccgagtcctcgtcactgttgggggacgcccaggccttactgagaagtcccttagcagagacatcttgtatagagaccctgaaaatggatggagcaagcttacggaaatgccagccaaaagttttaatcagtgtgtggctgtgatggatggatttctttatgtagccggtggtgaagaccagaatgatgcaagaaatcaagccaagcatgcagtcagcaatttctgcagatacgatccccgcttcaacacctggatacacctggccagcatgaaccagaagcgcacgcacttcagcctgagcgtgttcaacgggctcgtgtacgccgcgggcggccgcaacgcagaaggaagcctggcctcgctggagtgctacgtgccctccaccaatcagtggcagccgaagacgcccctggaggtggcgcgctgctgccacgctagcgcggtcgccgacggccgcgtgctggtgaccggaggctacatagccaacgcctactcgcgctctgtgtgcgcctacgacccggccagcgactcgtggcaggagctgccgaacctcagcacaccccggggctggcactgcgcggtcacgctgagcgacagagtgtacgtgatgggcggcagccagctggggccgcgcggggagcgcgtggacgtgctcaccgtggagtgctacagccccgcgaccggccagtggagctacgcggcgccgctgcaggtgggagtgagcactgcgggcgtctcggcgctgcatggccgcgcctacctggtggggggctggaacgagggcgagaagaagtacaagaagtgcatccagtgcttcagccccgagctcaacgagtggacggaggacgacgagctacccgaggccactgtcggcgtgtcctgctgcaccctctcgatgcccaacaacgtgactcgggaatcccgggccagttcggtatcttctgtgccagtcagtatctgagcccaggtagatgcagggacgcaggaagaacacgttatttattcgtagagccacgtggttaacctctgagttcgcgaaaaggaaaatatttaacatttactacactgattgtattgtaaaatatgtcgaggcacatgtcctgatggctttaaattcctggtatggcataatctacctcttttttttttttttttttttagcaaaatacagggcaatggccaacaaaagaaacaatttatttcagcggccactgggtggcagacggaattcgttataggcactctcccaaggcggcatgtttcctaaatgtatagcggttacacccacatttgagattttttcctctacacgttagtacacttgaggtttatgtaagtgatttcatgttcaaaagtttattttcctctctctcttttttctttaggaagttgaagatattcatatagattttatttatttaaaaatggaaattgtcgatctccataaagacttaagatttaattctgtatttcaacgcaattttccccccatatgtgattgagtaaaggattttgaaagatatcccatgacaacgtaataaagcttaaaacaagatctgaccgaaaaggaatagggattccacccagggaccctaaatttgataacctttgtgttagcggacattcctcttcctccatgcctcaggccccagtttattttctaccataaaatcatgctctcaatgaagtaattgatatgaatcatttaatttatagcataaatttaagtcatttggttgtttcaactagaaggatttgcattttatcccttgtcctctattaaagaagaatttcacataccctgggagccttaccctcaccctaaaaactacaccaacctggttaaaggcaaccttggccctaatgtacaccccgcgaagatcaccaaataaaactatgtccctaaggaccattagccttaagcttagagagcttgaagtttacacaaccaataacaataattttatttgccccaatcttttatatgataagaatgatagaaacatttggaatttgtagatttggtagtaactggatgaatgggttctcctgttgataaatgccattgtttcccatttaatatggatcctcctgatttcttaagtaaaaatcaagcactcatctcacgtatataaaaatatatactcattctgtcctatttttattaatctcatctgctccaaatgagctttggatttataatcaaagtgtacccacttgatagcacttttcctatatgtttgccaagttttggggaaagggaatgactgtagtaaatgatacatattttccttttttataatttatcactttattctttgacagtttatttgttttggagaggaagtggcctatcaattatgggttatgtgcaattggattttgaaaaataaaacaagctatttaggaattgaacatgagatatatggaaatataatttggtttttgttaatctcatcctctccaccttgtgtagataggttattgctagttatgatatttatttctaaaatatgttatttgaactgtgaaaagtggttcatatagtacactttgtggaacaattttatatcattaccccgatgaaaagttcaatctctggatatttaatgataacactcaggtaagggctacaaacgctgtaaattaagaacaagatattattaatgtaaaagcgctgggctgtttccttatcccacacaaagaatcttttaccttggtatatgtggatatggtatattaccttggtgtatgtatatgtgtgtatacgcacacactcatacaactgagaagcctatagtatatggttaatttttggagaaaagggtgttttattgtgggttacagatcataagtgagtgaatagatgtaattccttgatgcacaccaatagatgtgttcccattgacatcttagaagtattgtatgaagaggaggacctagggcttgaaatgaaatgagaatcaatcaattgcaacattacatgatggaataatgagaagagatactgaaactagaggatttttcatctatcaaagcttgataaattaggttgtgcaaaaacttggcagtggctttctagagatgaaactggagacatgttagtgctggataaatcatttaaaattaccatttaatttattttctacattgtttatctgaagactcagaaaatccacatatttgagcttaccagactcttgggtgcattgctgttctatcttctgcttcaacagttaggaaaataaagaccaatatgaatttggaatgtcagaatttctgacataacacattggcgaggagtatggaatgtaagggtcggtgaaagtttcatatcctggaacatcttgcattgccaattgaaagacataaaagtatgcagaatcaaaataatatgtgtccactttcatgtgtaagtgaaacatattctttacaccaactattgaagcagttgctcctagaaacctagtttctccagatttcccaagtggaaaatatttagtatgttttaagcttacattcaattactccagagtcttaggacccaaccatatacttccttttattttttattaaagaaaatgacttgttatttttgtaacggctgagtcctgtgatcaaataaaagcatcagttcaatatatcagggaaattgcatgttacccagcaactgaaataataaaattcaagctctctttttctaaatgggccagagacctgatgagaaagtctccaggaagccaaactttaacatactttgtccatttttagttaggttcttggtgccaagttgtcatccctgatgcattagttgctttcagtgcattgaatgaattttatttttacttcctatgttgtaagaatggttttgaatagaaggtcagtgatggtacagattcgtataattttaaaacatgattagatggtagtgaagtgttatgagtgaggaggtataattgatgtcatgaggaagtgagtactgaatggttctatgatttaaggtaaagcagcagttgtagtaagtgtattttacaaatacacatgtaaatagaggtttacctggaaatatgtacgttctaaaaggtcaattttttaattttatttttttgctggttatcctggccaagtgtcttcagaactcatccaagttacgagacgaaataaactaaaatcacctcattaatttttttcccttagttacaaccaaatgaatttatgtaatctctgaatgaactacatccctattccagccgctgatgaatatgttctccagcacaaggcagcattaaaaggaaatacttttcagtatttcttttcatgccaaaaaacctacagaataattttccaaacagtcctttattcgtaattataagaattaaacaatctaaaatattaaagatttaccctccagcacattcactgggtaaagaccatttaatttgccctctcagggaatttgaaataaattatttgtcctggatattctttaaaaactttttatttattcagcaaattttggcaaaaaaatttctttctttgcttaaaacattctggtactatataaggaacaacaaactaaaatgtatgtagtgttattttgtaatctcatcactatcaataaagctgcattcaataagaccttagtcaatgactaaata

SEQ ID NO: 145326 - DNA, 1905 bp, Homo sapiens
  Payload ID: 8721
  Gene Symbol: KLHL31
  Gene Name: kelch-like family member 31
  Uniprot ID: Q9H511
  ENST ID: ENST00000407079
  CDS Start-End: 1-1905
atggcacccaaaaagaagattgtcaaaaagaacaaaggagatatcaatgagatgactataatcgtagaagatagccccctaaacaaactgaatgctttgaatgggctcctagagggaggcaatggccttagctgcatttcttctgaactaacagatgcttcttatggccccaacctcttggaaggtttaagtaaaatgcggcaggagaacttcctatgtgacttagtcattggtaccaaaaccaaatcctttgatgttcataagtcagtcatggcttcatgcagtgagtatttttacaacatcctaaaaaaagacccgtcaattcagagggtggatctcaatgatatctcaccactaggcctggccactgtcattgcatatgcctacactggaaagctcactctctccttgtatacaataggaagcattatttctgctgctgtttatcttcagatccatactcttgtaaagatgtgcagtgattttctgatacgggagatgagtgttgagaattgcatgtatgttgttaatattgctgaaacatactccctaaaaaatgcaaaagcagcagcccagaaatttattcgggataacttccttgaatttgcagaatcggatcagtttatgaaacttacatttgaacaaattaatgaacttcttatagatgatgacttacagttgccttctgagatagtagcattccagattgcaatgaaatggttagaatttgaccaaaagagagtaaaatacgctgcagatcttttgagcaatattcgctttggtaccatctctgcacaagacctggtcaattatgttcaatccgtaccaagaatgatgcaagatgctgattgtcacagacttctcgtagatgctatgaactaccacttgcttccatatcatcaaaacacattgcaatctaggcgaacaagaatccgaggtggctgccgagtcctcgtcactgttgggggacgcccaggccttactgagaagtcccttagcagagacatcttgtatagagaccctgaaaatggatggagcaagcttacggaaatgccagccaaaagttttaatcagtgtgtggctgtgatggatggatttctttatgtagccggtggtgaagaccagaatgatgcaagaaatcaagccaagcatgcagtcagcaatttctgcagatacgatccccgcttcaacacctggatacacctggccagcatgaaccagaagcgcacgcacttcagcctgagcgtgttcaacgggctcgtgtacgccgcgggcggccgcaacgcagaaggaagcctggcctcgctggagtgctacgtgccctccaccaatcagtggcagccgaagacgcccctggaggtggcgcgctgctgccacgctagcgcggtcgccgacggccgcgtgctggtgaccggaggctacatagccaacgcctactcgcgctctgtgtgcgcctacgacccggccagcgactcgtggcaggagctgccgaacctcagcacaccccggggctggcactgcgcggtcacgctgagcgacagagtgtacgtgatgggcggcagccagctggggccgcgcggggagcgcgtggacgtgctcaccgtggagtgctacagccccgcgaccggccagtggagctacgcggcgccgctgcaggtgggagtgagcactgcgggcgtctcggcgctgcatggccgcgcctacctggtggggggctggaacgagggcgagaagaagtacaagaagtgcatccagtgcttcagccccgagctcaacgagtggacggaggacgacgagctacccgaggccactgtcggcgtgtcctgctgcaccctctcgatgcccaacaacgtgactcgggaatcccgggccagttcggtatcttctgtgccagtcagtatctga

SEQ ID NO: 145327 - DNA, 708 bp, Homo sapiens
  Payload ID: 8722
  Gene Symbol: KLHL32
  Gene Name: kelch-like family member 32
  ENST ID: ENST00000369254
  CDS Start-End: 53-472
tgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctg

SEQ ID NO: 145328 - DNA, 3698 bp, Homo sapiens
  Payload ID: 8722
  Gene Symbol: KLHL32
  Gene Name: kelch-like family member 32
  Uniprot ID: Q96NJ5
  ENST ID: ENST00000369261
  CDS Start-End: 364-2226
tttactagggagcagtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 145329 - DNA, 791 bp, Homo sapiens
  Payload ID: 8722
  Gene Symbol: KLHL32
  Gene Name: kelch-like family member 32
  ENST ID: ENST00000447886
  CDS Start-End: 1-531
attttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagaagtgtggaatttgtgctgccttttgtgcactgaggggagactggtgccctggcttacctcaatgggatgacaagactgctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtgg

SEQ ID NO: 145330 - DNA, 3699 bp, Homo sapiens
  Payload ID: 8722
  Gene Symbol: KLHL32
  Gene Name: kelch-like family member 32
  Uniprot ID: Q96NJ5
  ENST ID: ENST00000536676
  CDS Start-End: 473-2227
ggcgtctgaacccgccccgggggtgccaaggtgcgtctccagtctgacgcgaccgcctggggcggagtcagcgggacgtgccacctgcagtgctggctagggctttttatttactagggagcagtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccggattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 145331 - DNA, 3600 bp, Homo sapiens
  Payload ID: 8722
  Gene Symbol: KLHL32
  Gene Name: kelch-like family member 32
  Uniprot ID: Q96NJ5
  ENST ID: ENST00000539200
  CDS Start-End: 473-2128
ggcgtctgaacccgccccgggggtgccaaggtgcgtctccagtctgacgcgaccgcctggggcggagtcagcgggacgtgccacctgcagtgctggctagggctttttatttactagggagcagtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 145332 - DNA, 2864 bp, Homo sapiens
  Payload ID: 8722
  Gene Symbol: KLHL32
  Gene Name: kelch-like family member 32
  ENST ID: ENST00000544166
  CDS Start-End: 862-1392
ggcgtctgaacccgccccgggggtgccaaggtgcgtctccagtctgacgcgaccgcctggggcggagtcagcgggacgtgccacctgcagtgctggctagggctttttatttactagggagcagtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 145333 - DNA, 2642 bp, Homo sapiens
  Payload ID: 8722
  Gene Symbol: KLHL32
  Gene Name: kelch-like family member 32
  ENST ID: ENST00000620278
  CDS Start-End: 700-1170
ggttcactgcagattatcaatcagtggaaagtgatagaagcaatggatcagcagaatgggtatagaggcaatgttcagtctttgtatggtggaaagtggagctgatgaggttaatttgcacggtgtgaccagccttggcttaaagcaggctctggagtttgcatacacaggacaggccatgcctcttctgcaagactatacaacatccttgctcctctgatgggagctgcactaatttcgtgaatgtcagtcaaagcctccttccttgaggagttggcgaaagacgggtttctctttctgactagatggaaaaggagatataaagatttttcagaataagatgagtattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 145334 - DNA, 1863 bp, Homo sapiens
  Payload ID: 8723
  Gene Symbol: KLHL33
  Gene Name: kelch-like family member 33
  Uniprot ID: A6NCF5
  ENST ID: ENST00000344581
  CDS Start-End: 224-1825
ccaggcccctggtcccaaggaaccttccctttccagccttgtccctagaggaagaagaggaagaggaagaagatgaagatgcggcagagcccgagtggctgcgcagcgaggagcatccgagccagtttttcgccgaggcccagcggctgcgggagcagagactgttgctggacgaagagtgcaccgagccgccctggcctgtggcagtgagttctttggggccatgctcctgagcgggatgagggaatcccagggcacagaggtatctctgcggacgatctccacccaggacctgcgactcctcgtctcttttgcttactccggagttgtgcgggcaaggtggccagggctactgagagctgcccaggctgctctgcagtaccagagctcttcctgcttggatttgtgtcagaaaggcttggcacggggcctcagccctgcccgttgcctggccctgttccccatggcggaagcccctgggttggagaggctctggagcaaagcccgtcactacctcctcacccacctgcctgctgtagccttgtgtcctgctttcccttctttaccagctgcctgcttggctgagctcctggatagtgatgagctccatgtgcaggaggagtttgaggcctttgtggctgcacggtgttggctggctgccaaccccgagacccaggagtcagaggccaaggccctgctgcgatgtgtccgctttggccgcatgtccaccagggagttgcggagggtgcgggcagccgggctacttccacccctgaccccagatctgttgcaccagctgatggtagaggctgatgttccaggccaagagagacggagggagcctgaccgggcactggtagtgattggcggggatgggctcagaccagacatggccctaagacaaccatcccgagcagtgtggtgggcccgggccttccgctgtggcgtgggactggtacgaactgttgagtgggggcagctgcctgccctgcctgcccccggacgcttccggcatggggctgcaagcctggcaggaagtgaactctatgtgtgtgggggacaagatttctacagtcactccaacaccctggcttcaactctcaggtgggagcccagtcaagaggactgggaggagatggctcctttgtcccaggctcgaagccttttctccttggtggcactggatggaaaactttatgccctgggtggaagacacaatgatgttgccctggactctgtggagacctacaaccctgagctcaatgtctggaggccagcacctgcacttccagcaccatgttttgcccacgcagctgcgattttggagggccagttgtacgtgagcggtggctgtggtgggactggccaatacctggcctcactgatgcactatgaccccaaacttgagaagccagggacgtttctgagccctatgggggtacctcgggctggccatgtcatggctgcattgggtgggaggttgtatgtggcaggtgggctgggtgagactgaggacctgctaagctttgaggcctatgaactaaggactgatagctggactcacctggcacccctaccctccccccatgtgggggctgcaagtgctgtgctgcagggggagctactggtgctcgggggctacagtcaccgtacttatgccctctctcaccttatccatgcctactgtcctggcctgggccgatggctctgcctgggaactctgccaaggcctcgggctgagatgcctgcctgcatcctgacactgcccgctgtgcagcacatagctttggttcccaccccacaccaaaccaaacctgctgggtgaagagggagcaacagtgtatggggagaggagggcataag

SEQ ID NO: 145335 - DNA, 3641 bp, Homo sapiens
  Payload ID: 8724
  Gene Symbol: KLHL34
  Gene Name: kelch-like family member 34
  Uniprot ID: Q8N239
  ENST ID: ENST00000379499
  CDS Start-End: 543-2477
agttgtccccggccttcgcgggtgcccgcagaacccgtcctcctcgtccaccccggagaggtcagagtcctcgccctgcactcccgggacgccgcatctgcgccgtcggacatccagcacccccggagtccaccggcaactcggttcttccaggtgatggtgtgcagccaccgccgcccctggcgtgcaggtgtgggctctccacattgggccggggaggggacttcgggcaacgcgctggaagcctcggcagtcgtggaaaccaagccccacactcccgggaagcctccaaattccgcgccctccgttactaggggcctccgaaaaccgtttccagactggatttgctctgagaggggcactgggcgatctgcaggtctggatgaaggagccctgggctttaaactgagcaggcagaaatgggcccctgctaggggctctgtggcttacgcgggggtcccgggagtgttgtgccccgggatgcctccggccctgcccagcaggcctctggtcccaccaggctgcttccagccctgggtagaatgagttacttcctgtcttactgcaaagctcatggcggcgcgctgctcaccggctaccaggccctgcgcgccgagggcttcctgtgcgacgtgacactggagaccgagggcagcgaattcccggcgcacaggtcgctcctggcgtgctccagtgactacttcagggccctgttcaagagccacacccaggaatcccgggcgcgcgtgatccacctgcacgtgccatcggcagccggcctgcagcgcctgctggacttcatctacactgcctggctgtcgctttccatggacactgtagaggacactctggaggccgccagctacctgcaggtcactgaggccctggggctctgtgggcgctacttggagcgccagctggctccagagaactgctgcttcgccgccaacgtggcagcgcgctttggcctggctcacacgctggacgcggccgagcgctgcatcgtgagccacttgcaggagctgctggcgcggggcgcgggccccgcgggactcctggagctcaaccctacatcgctgagggctgtactgggtgcccccgacgtggcgcgggtgcccgaggcccggctactgggcctggcgttagcttggttgcggcaggagcccacaactgagcgcctggcacactgtacagagttgctggagcgtgtccgctttggcctggttcccgccgacgtactgcggcgcgtgtactcgggctctggcctcgtgctgcccgcccgggtcaagggcctcatcatccaggccctcaactaccacacgacgccctcccgccagccgctcatgcagggcgagcagaccagcatccggagcccccagacccgcatcttgttggtgggggggcgcagggcacgggaggtggtgattgaggaggtcgcggccccgcagagggcagctaggggccaggtcgccgccccagagcccgaggaagaagaggaagagttggaggaagaggaggaggaggaggagtgggagctcacccagaacgtggtggccttcgatgtgtacaatcaccgctggcgcagccttacgcagctacccacaccactgctggggcacagcgtgtgcaccgcgggcaacttcctgtttgtcctgggtggggagagcccttccggcagtgcatcctctcccctggccgacgactcgcgggtggtcacggcccaagtgcaccgttacgacccgcgcttccacgcttggacggaagtgcccgccatgcgggaagcgcgggcccacttctggtgcggcgcggtgggcgagaggctcctggccgtcgggggcctgggtgcgggcggtgaggtgctggcctcggtggagatgtacgacctgcgtcgggaccgctggacggcggctggggcactaccgcgggctctgcacggtcacgcgggggccgtcggggaccgcggtgttgtgtacatctcggggggcaaggcagggagaggcgagggcggagcgagcagcctccgggacttatacgtcctgggccctgaggagcaggtttggagcaagaaggcacccatgggcaccgcacgtttcgggcaccacatggcagtgctgcgcggcgctgtgtttgcttttctggggcgatacgagcccttctctgagatcgagcgctacgaccccggcgccgaccagtggactcggttgcggccgctgccctacgaccgcttctgctatgggctggccgtggtcgaggagacagcgttgctgctgggcggcctcaagtggcgggactcgcgccaggtgcctacccgcaacgtagtgggctacgacctcgacctggaccgttgggaggacatcggctgcgcgttgccctgggcctggagcggcctgcggtgcgcagtgctgcagctggccgagggtggggacgacgagagggagggagaggttggagaggcgctagatttggtgctgggctgaatgggtcagtccggtttccttccgcaatggaggagaaagtcgcgcttggttagtcttacagagcaacggatgggctttttctaagaaagggattctgggagcagagtggcttctgaaggttaacaggcaaacaaggccttgagcaaagagaaacatttctccttgagctgagaatgggagacagcggggcggggggtcaaatagaaggctatatgaatcaacttcagtgagctggtgaaagaaaatttttagaaaggctcacgcaaggctagagaaggactttcacaaataaaatatgaccttattttccctcttacagttaaagtgtttccctaggtgcaaaacagtgattacttatgtgccaaaaaaaaaaaaaaaaaaaaaaggccaaaaaatgtaccacaggaagtttatacaaaactcagaaaattgttggctataaaggctgtaattaagtcctaggagatggcattatctgaataaatagtgaaaggagagtgccttggttaaataccatgaaatcattgtaaggagaactatgattttatgatccggagccatggttacagttctgctctgatggtttgatataaatatggaactgagaaggaaaaaaaaaatctctaagcacttttttttaatctagaaagtatccttaaatttttctgtcaccggtgtcaccctaggctgcttttgccctgactttagacagctcactggttttaagtcacatttcatcaacccttagccataataatcaggatcctctggttaagtggaatgtctaaccaaaacaaaacaaaaactgatttctttcatactcttttaaatgttcattctgcagacatactgtagattatatttgtaaaaaaaaatcaatttttggtggttacccccacttcccccaaaagaatcacagagaaaggaaagaggaataggtaaagttttaaacttcgtctcaggtaaatgggaaacgagcttgatttttcagggtcttagataagacacttgtatatactgaacaggtgctgcttttggcttgtatcaccaatgaggcagcaaagttagaactcgaaactagggtggggggtggtggctgtataattaggtcacaaagaaatgtggtaaggactttgcatgaataaagtaggtgctttataagga

SEQ ID NO: 145336 - DNA, 1500 bp, Homo sapiens
  Payload ID: 8725
  Gene Symbol: KLHL35
  Gene Name: kelch-like family member 35
  ENST ID: ENST00000376292
  CDS Start-End: 223-1314
gagggccgcctgcgcgccgccaacagcctagcgctgcgccgcgtggccgccgccttctcgctggccccgctggccgagcgctgcggccgcgtcctgcgtcaggccttcgccgaggtggcgcgccacgccgacttcctggagctggcgcctgacgaggtggtggcgctgctggcggaccccgcgctgggcgtggcgcgcgaggaggccgtgtttgaagcggccatgcgctgggtgcgccacgacgcgccggcccgccgcggccagctgcgacgcctgctggagcacgtgcgcctgccgctactggcgcccgcttacttcctggagaaggtggaggcggacgagctgctgcaggcctgcggcgagtgccgcccgctgctgctcgaggctcgcgcctgcttcatcctgggccgcgaggccggtgcgctgcggacccggccgcggagattcatggacctagctgaagtgatcgtggtcatcggcggttgcgaccgcaaaggtctcctgaagctgcccttcgccgatgcctaccatccagagagccagcggtggaccccactgcccagcctgcccggctacactcgctcagaattcgccgcctgtgctctccgcaatgacgtctacgtctccggaggccacatcaacagtcatgatgtgtggatgtttagctcccatctgcacacctggatcaaggtagcctctctgcacaagggcaggtggaggcacaagatggcagttgtgcaggggcagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggaaagctgtggagtcactgtgtgtgacgggaaggtccacatccttggcgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccagctgcagtctgccctgcctggagatggaatgtctaa

SEQ ID NO: 145337 - DNA, 1936 bp, Homo sapiens
  Payload ID: 8725
  Gene Symbol: KLHL35
  Gene Name: kelch-like family member 35
  Uniprot ID: Q6PF15
  ENST ID: ENST00000539798
  CDS Start-End: 1-1752
atgcggcaaggccatgcgccggaggagtcggagccgggctgcgaagcgccgtgcgcgggtccgtgccacgcgcagcgcgtgctgcaggccctgaacgcctaccggcggagcggcaccctcaccgacgtggtgctgcgcgccggcgggcgcgactttccgtgccaccgcgcggcgctcagcgcgggcagcgcctacttccgcagcttgttcgcggccgggcggcccgagcgcggcccggccgtggtgccagtggtgccagtagctcccgaggcgccaggcacgagcccggccggggcggcggcggcgctggccgtggtgctcgactacgtgtacggagcgggcgtgcggctgcgcgcggaggacgaggcggcggccgtgctggcgctggcggagcggctgggcgtggcgggcctgcgcgaggcctgcgtgcgctttctcgagggccgcctgcgcgccgccaacagcctagcgctgcgccgcgtggccgccgccttctcgctggccccgctggccgagcgctgcggccgcgtcctgcgtcaggccttcgccgaggtggcgcgccacgccgacttcctggagctggcgcctgacgaggtggtggcgctgctggcggaccccgcgctgggcgtggcgcgcgaggaggccgtgtttgaagcggccatgcgctgggtgcgccacgacgcgccggcccgccgcggccagctgcgacgcctgctggagcacgtgcgcctgccgctactggcgcccgcttacttcctggagaaggtggaggcggacgagctgctgcaggcctgcggcgagtgccgcccgctgctgctcgaggctcgcgcctgcttcatcctgggccgcgaggccggtgcgctgcggacccggccgcggagattcatggacctagctgaagtgatcgtggtcatcggcggttgcgaccgcaaaggtctcctgaagctgcccttcgccgatgcctaccatccagagagccagcggtggaccccactgcccagcctgcccggctacactcgctcagaattcgccgcctgtgctctccgcaatgacgtctacgtctccggaggccacatcaacagtcatgatgtgtggatgtttagctcccatctgcacacctggatcaaggtagcctctctgcacaagggcaggtggaggcacaagatggcagttgtgcaggggcagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggaaagctgtggagtcactgtgtgtgacgggaaggtccacatccttggcgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccagctgcagtctgccctgcctggagatggaatgtct

SEQ ID NO: 145338 - DNA, 1974 bp, Homo sapiens
  Payload ID: 8726
  Gene Symbol: KLHL36
  Gene Name: kelch-like family member 36
  Uniprot ID: Q8N4N3
  ENST ID: ENST00000258157
  CDS Start-End: 132-1793
gccatggctgcgcagcgggctggccgggggtctcctgaacccgggccccgccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacata

SEQ ID NO: 145339 - DNA, 585 bp, Homo sapiens
  Payload ID: 8726
  Gene Symbol: KLHL36
  Gene Name: kelch-like family member 36
  ENST ID: ENST00000567410
  CDS Start-End: 293-585
ggggctgtccccgccgcgtccgtagcgcgtcctgccaggtgggcctccgcgcgcgcccaccctccagcccgggaccgccaggaagccgcgcccggccggggcggggagctggcggagatcgggagggtccccggccaccgcgagccgcgacccccctgcgccccttggtgccggggcgggcgggtgggcgagtgggggcgccgcggccgggggaggggccgccgcccccgcaggtgacacaggtgcggcctgtgcggaccgccccgcgcgtggcagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaa

SEQ ID NO: 145340 - DNA, 508 bp, Homo sapiens
  Payload ID: 8726
  Gene Symbol: KLHL36
  Gene Name: kelch-like family member 36
  ENST ID: ENST00000569472
  CDS Start-End: 162-508
gcctcctcgccgccggctggagcctgctgggcggccgttgcgctgagttccgcctgggctgcggggtccgagcgaacgacagcggcgtccccggagaccccgccggcgagccggtgtcagcagcgtcgctttctccaacgctgagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacat

SEQ ID NO: 145341 - DNA, 555 bp, Homo sapiens
  Payload ID: 8726
  Gene Symbol: KLHL36
  Gene Name: kelch-like family member 36
  ENST ID: ENST00000565743
  CDS Start-End: 370-555
gagttccgcctgggctgcggggtccgagcgaacgacagcggcgtccccggagaccccgccggcgagccggtgtcagcagcgtcgctttctccaacgctgaggtcgggagggagcttggggaggaggcgctctgggaaacccccggccggacggggcctgcggtcccatgtttactggaagaccttttccagtgacctgggattgtcactgtgcttgggggtggccttgacccttcacctgcttccaaaaagcgtcggaggccgctgacgtccaacacgggtggaaatcagaccccacccccacgcacttgcaggagacagcagggagcctccggccccgcgaactctctctagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaac

SEQ ID NO: 145342 - DNA, 2173 bp, Homo sapiens
  Payload ID: 8726
  Gene Symbol: KLHL36
  Gene Name: kelch-like family member 36
  Uniprot ID: Q8N4N3
  ENST ID: ENST00000564996
  CDS Start-End: 142-1992
tcctggcggagccatggctgcgcagcgggctggccgggggtctcctgaacccgggccccgccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacata

SEQ ID NO: 145343 - DNA, 1982 bp, Homo sapiens
  Payload ID: 8727
  Gene Symbol: KLHL38
  Gene Name: kelch-like family member 38
  Uniprot ID: Q2WGJ6
  ENST ID: ENST00000325995
  CDS Start-End: 25-1770
ggggcttccttccctctttgtaggatggacgaggagtcactagatgggctgctcttcaaagaccacgacttctcttctgacttgttgaggcagctcaacagcttaaggcaaagcaggatcctgactgatgtgagcatctgtgccggtgcccgggagatcccctgccaccgcaacgtgctggcctccagcagcccctacttcagggctatgttctgcagcagcttccgggagaagagtgaagccaaagtgcagctgaaaggcattgaccccccaaccctggaccagatcgtctcctacgtgtatacgggggaggcacatattgccactgacaatgtcctccccgtgatggaggccgcctccatgctacagttccccaagctgtttgaggcctgctcctcgtacttgcagagccagttggcccccagcaactgcctgggtatgatcagactctcagaaatcttaagctgcgagaccctcaagaagaaagccagggaggtggcactgacgtccttcccagaggtggccgcatcggccgacctgaaggagctctgtgccttggagttgagggactatctcggagatgatgggctctgtggggaggaggaaaaggtgtttgaggccctcatggtttggatcaagcatgacctccaggcccggaagcgatacatgcaggaactgttcaagcaggtcaggctgcagtacatccacccagccttctttcaccacttcatcgccaacgatgccctcctgcagtcctcgcctgcatgccagatcatcttggagaccgccaagagacagatgttctctttgtgtggcaccaccgtcccagactgcaaactcctgttgcatgtccctccaagaaactcttaccaagatttcctcatcctcttgggcggaaggaaggacagccagcagaccaccagggacgtcctactgtacagcaaacagaccggccaatggcagagccttgccaaactcccgacacggctgtacaaggcctctgccatcaccttgcaccgcagcatctatgtgctggggggcatggctgtcagctcagggaggagtctggtcagtcacaatgtctacatcttctccctgaaactcaatcagtggaggctgggggagcccatgctggtggcccgctactcccacagaagcactgcccataagaacttcatcttctccatcggggggattggagaagggcaggagctcatgggctccatggaaaggtatgacagcatctgcaatgtctgggagagtatggccagcatgcccgtgggggtgctccaccccgcagtcgctgtgaaagaccaaagactctatctctttggaggagaggacatcatgcagaaccctgtgcgccttatccaggtttatcacatttccagaaactcgtggttcaaaatggagacaagaatgatcaagaacgtgtgtgcccctgcagtggtgcttggggagcggattgtcattgtgggaggttacacaaggaggattcttgcttatgaccctcaatccaacaaatttgtcaaatgtgcggacatgaaagaccggaggatgcaccatggggccacagtgatgggaaacaaactctacgtgacgggcgggcggcggctgaccacggactgcaacattgaggactccgcctccttcgattgctacgaccccgagacggacacctggacatcccagggacagctgccgcacaagctctttgaccatgcctgcctcactctccagtgcataccccgcacgtctggcctcccatgaggtcgacaagaaaccttctgccctagtcaaaatgccttctgtcgccagggacacaaacccagctccaaagggcttaacccttaaaggctgcagggagagctcacaagactgaggtaccagagtcgggaggcctggaactaggcattgcattgccagaactctctctctccttctctgcctctctccttatctctctcccccacctccatctg

SEQ ID NO: 145344 - DNA, 2445 bp, Homo sapiens
  Payload ID: 8728
  Gene Symbol: KLHL4
  Gene Name: kelch-like family member 4
  Uniprot ID: Q9C0H6
  ENST ID: ENST00000373114
  CDS Start-End: 81-2243
gaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggaccaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagagagcatgcaagaacttctacaaaacttctataccacacagaagctgaaagagactctggggcactaaattcagatcctttctccacacagcaatgacatttatcaatctgactcaggtgtggctgttgcccctttttgatatggagggaacactgaaagacagtttccttctggagttccaaatgcaatatagaaaaaaaaaccctgtgactctggattttattttaagttctctaacaagactcctaccttgagatcttagtctaggt

SEQ ID NO: 145345 - DNA, 5818 bp, Homo sapiens
  Payload ID: 8728
  Gene Symbol: KLHL4
  Gene Name: kelch-like family member 4
  Uniprot ID: Q9C0H6
  ENST ID: ENST00000373119
  CDS Start-End: 146-2302
agtgggggaggggagagaaagcaagaaagactgctctcggcacttgtgcttttgttagttctacagaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggaccaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagaggaagttcctgttaacattggaagagctggtgcatgtgttgtagtggtgaagctaccctaaagctatctatctttatcaaatggaatgaaactagataatttcaagaaactgagtaggacaaagggagaaagaaatacatgttctttttcctgcaattaataatcagactggaaaattgttgtatcattttaatttgtagttacaattgctttcattcgtgaagccgaaacgtttttaaacatgaattacatatgaattattaagcatatgtgctttcgcagctgataatataaaaggaaatcccacagtctagatatagccccattactacaaaatgctaaaatatttaatgaaaattgatggtggccacagtgtgcaggttataaaagcattaatacatttcaaggtaagagccttaaaagttaaaaacattttcagtttttttttaaaaaacgtactcttattatctggaacatagaaatataaaaggtaacatctaaagcttagaatagtgtgatttttagtaagccattattctcctattcaaataatatcccaaagagctaaacaattccttacatttaccaagaggaaagcttttactgtgttgaagctaaaaaaataatggctctttgacaaaacttgttatgttgatcgcggtatgtcaaaatttttacaggtttgctcatctgccagagcacacatataaatttggtatttcttaacatattatcttgttagatttgttaccagtaaaatattactgtaatttcatatacacagtctatacaatgaaataatgaatatttatcatattgatacaaactgtgacctcagcttcagagtgtcagggcctcacttgtatagaatgtaatgttctcctcaaacatttatgttaactctataaacaaatatcgttaagttaaacaagttttcaaaaacaaaacaatttttaaagtaccttaaaattgaggatgttactcagtgttaacacatgggaacaccaaaatattcaataagcctggtcaattctatagttatcttttttgtaccaacacatgcttttctgttactgttatattatccagtagaaaatgttaggatatgtgtgctatataaaaaaaaaaaaagacttgttaagttttaaaataacaaaaatggctagttgaatagtattttatgtgtaattcttccatttattctgtttaattatacaactaagatgaaatattgaaaaaccctttgtgaaagtaacttttcaagtaaatgcacaactttagaatttctacaaataagttcttttaaacagtctttttattgtggattgtgaaatcaaaatctggagaaatgcttataaaatatactactagcttttaagttttaagaaagaagaacgtaagttgtacaaagatatttgtactttgacaaactgaatttaaataaactttatttcctctcactatagtgtggctttagaatatatcaagtacaacctgaatggactttttgattttacatttcctatatcactaaaatacttaaacacaaaaataaaattccactcctttatttcttcttacacctgccattgtctctaattctaaagagagagctatagatttctgcagttctagaggtgaagatagagacatagagaggctgtgaaacacacatacagccctgttaggtcttttgaattcacaccttattgaaatcagtgtagaagtagagttacctaaacctttatcgccaatgcacagcttggcctgttaagttaaatgtgggtgtcaaccagtggaaaagatcaaaggaccttttgcagcctagcttgccaatcttccagtaacaacgaggtgctaccaataggcagactgtgtctagagtcatgcatggacaagaggaaagtgaaagttgaatactctcttctcaatggcatagctggacttgattaagtattgactcatagaagagacatgtatgtttcccggggctaccccttcatagctgcatttaaaaatggtgttcaggccactatggctgctgtggtttgaatatttttttccctcgaaaactcatgttgaaacttaactcctaatgtagcagtactgagaggcagggcccttaagaggtgattgggccatgaggtctgtgccctcctgaatggattaatccattcatggattaatggattattatgagtgggggactggtgactttatatgaaaaggaaggaagagtgacctaagctagcatgctcagggtgcaccgtatgtcccctggtcatgtgatgctatgtgttaccttgggacttacctgacagctcttaccaacaagaaggccatcccagatatggcctctcaacctcagacttctcagcctgcctaactgtaagaaattaattctttttctttataaattacccaggttctgttttaagcctcagaaaatgaactaagacaatgccctagatgagctgccaaaatctgagcagatatgagccatcagaatagagacctgcagaggcccagggcactcaaacataactgtgcttgtctcagtcaaacttaattgggaaaaggaggagtaagagcaggccctttctgacatgctttagcagagataacttatcagggctagtttaaacaaatgtgtataggaaaggatgttatttatatattcttacaagagtgtaagggctcacacatttactgtactcagatctgaaagacaatgttgcttcttgatttttttctataatcactatgaccgtgttcacgattccctactctgcaactctcagcatgcatcatgatgattctctaacactgtctgtcaccttcctgtatttccacagagcatgcaagaacttctacaaaacttctataccacacagaagctgaaagagactctggggcactaaattcagatcctttctccacacagcaatgacatttatcaatctgactcaggtgtggctgttgcccctttttgatatggagggaacactgaaagacagtttccttctggagttccaaatgcaatatagaaaaaaaaaccctgtgactctggattttattttaagttctctaacaagactcctaccttgagatcttagtctaggtaaagaaaaaaaaaaaaaggtcatgaaacacaaatgtcctcaactgtcatcattctatgtttactttctcccaatcacatcacctgaggtagaagagatttttcagttgctatttctcttcgtaatgaattttctttacatcctgtccacactgctggagatactaagtcccaacctaaatgatggaaggagcatctcccctcttgtctgtggaagatatcacatgaactacctaattttcaagcatggatctccatatttcaaaggaaagttttaaaaatgtttttaaaacttcaaatatctcaccacagtgaattatgggtaaggtgataatatgtttaattagcttgatttaatcatcccacactgtatacatatgccaaaatatcattttgtatgccataatatatatgatttatgaattatagtaatattaataaaagtgttaaagcttt

SEQ ID NO: 145346 - DNA, 2517 bp, Homo sapiens
  Payload ID: 8729
  Gene Symbol: KLHL40
  Gene Name: kelch-like family member 40
  Uniprot ID: Q2TBA0
  ENST ID: ENST00000287777
  CDS Start-End: 101-1966
cctcgaagacagctgctcagtctaagcaaaccccagcaggaaagcaggggtacagagaggagcccccttggcaccgccaccgcaccctaggccacccaccatggcgctgggcttggagcaggcggaggagcagcggttgtaccagcagacgctcctgcaagacgggctcaaagacatgctggaccatggcaagttcctcgactgtgtggtgcgggcgggcgagcgcgagttcccgtgccatcgcctggtgctggccgcctgcagcccctacttccgggcgcgctttctagccgagccggagcgcgcgggcgagctgcacctggaggaggtgtccccggacgtggtggcccaggtgctgcactacctgtacacatcagagatcgcgctggatgaggcgagcgtgcaggatttgttcgccgcggcacaccgcttccagatcccttccatcttcaccatctgcgtgtccttcctgcagaagcgcctgtgcctctccaactgcttggccgtcttccgtctcggcctcctgctcgactgcgcgcgtctcgccgtggctgcccgcgacttcatctgcgctcacttcacgctggtggcgcgcgacgctgacttcctcggactctcggccgacgagctcatcgccatcatctccagcgacggccttaacgtggagaaggaggaggcagtgttcgaggcggtgatgcggtgggcgggtagcggcgacgccgaggcgcaggctgagcgccagcgcgcgctgcccaccgtcttcgagagcgtgcgctgccgcttgctgccgcgcgcctttctggaaagccgcgtggagcgccaccctctcgtgcgtgcccagcccgagttgctgcgcaaggtgcagatggtgaaggatgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccctgcgcttcggcatgttcctgcaggatctcatcttcatgatcagtgaggagggcgctgtggcctacgatccagcagccaacgagtgctactgtgcttccctctccaaccaggtccccaagaaccacgtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctgtcattcaaatggggtgaatcggacccgctgccttacgtggtgtatggccacacagtgctctcccacatggaccttgtctacgtaattggcggcaaaggcagtgacaggaagtgcctgaacaagatgtgcgtctatgaccccaagaagtttgagtggaaggagctggcacccatgcagaccgcccgctcactctttggggccactgtccatgatggccgcattatcgtggcagctggggtcaccgacacagggctgaccagttctgccgaagtgtacagcatcacagacaacaagtgggcacccttcgaggccttcccacaggagcgtagctcactcagcctggtcagcctggtgggtaccctctatgccattggtggctttgccacactggagacggagtctggagagctggttcccacagagctcaatgacatctggaggtataacgaggaggagaagaaatgggagggtgtcctgcgggagatcgcctatgcagcaggtgccaccttcctaccagtgcggctcaatgtgctgtgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggcaagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctgtccgatgggagcatccccatcaagtgcagtgtacagtgcagatatgtctccttctttaggaagaataaagtgccttctgagcaagcagctcagggtctgcatcagtgctccaagagtcagtgagcaggtgtgttgaagacttggggcttcagtgttctgctgttgggctgccaaggtcgatggtctctgctctccatctggtgtc

SEQ ID NO: 145347 - DNA, 2464 bp, Homo sapiens
  Payload ID: 8730
  Gene Symbol: KLHL41
  Gene Name: kelch-like family member 41
  Uniprot ID: O60662
  ENST ID: ENST00000284669
  CDS Start-End: 78-1898
ctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaacaaattattttgtgaatctgtttcactcaatggattgtaaagaaggctcctaaatttgagttgtttgctaatcatttcatttgcatcattagggtatccttaaactgattttctattacaattggaagtggagaatatgtgcatctacactaaaaaaatgtttaagatatcaaaaacctctcctcgtgcttcaaaatgacaggaatcctgtgcattatactaagaattacatgccataagatgacttcagaaatcctacttcagaagtgtaataaatggatggggaaatcgtttgatggggaaaagtctcttgtaagtaaaagtagtcaaattcaaatggc

SEQ ID NO: 145348 - DNA, 6703 bp, Homo sapiens
  Payload ID: 8731
  Gene Symbol: KLHL42
  Gene Name: kelch-like family member 42
  Uniprot ID: Q9P2K6
  ENST ID: ENST00000381271
  CDS Start-End: 312-1829
ctggctgggagctggaattcccttcccgcctggcgccgcccgggagagcccgcgcgaggacgcccgccgcgctccgccggcccttttttggcgctgagggaaaggagaagggcagggccgccgcctcgcgggagcgggccccgggaggaggggccgccggagaggccgggcgagcgcgggcggccctcacctcgccgctcctcccgggccgccatccctcggcgccccgcccggaaccggcgcgcgcgtaggggctgggaggccggcgcgcagatctggcggtgagcgctgccgccccggggcccccagccatgtcggccgaggagatggtgcagatccgcctggaggaccgctgctacccggtgagcaagaggaagctcatcgagcagagcgactacttccgcgccctctaccgctccggcatgcgcgaggccctgagccaggaggccggcggcccggaggtgcagcagctgcgcggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgggggtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaaaaaaaaaaagaaaaaagaaaatcccccttcatcccccaggactgtcctttactctttgatagtatccctctattttcttcccaattctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctgtccgtcctttgtttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtca

SEQ ID NO: 145349 - DNA, 772 bp, Homo sapiens
  Payload ID: 8731
  Gene Symbol: KLHL42
  Gene Name: kelch-like family member 42
  ENST ID: ENST00000543254
  CDS Start-End: 1-538
cagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagaggtaagtgaagggaccaggtaggtggtctgcccatgtgtaggcgtcagcagtctgggaagggcaagagggtgtcagaggaagccccgacatatccgagtgtcatgttatgctttaatagtgtacacttacacatctggaaggaagagagttccatatggcagggatgattgggacaggagggatcttttgataactttgtgtgagcatgaaaatcgaatggggaagggagagctgtgaaaaaa

SEQ ID NO: 145350 - DNA, 1894 bp, Homo sapiens
  Payload ID: 8731
  Gene Symbol: KLHL42
  Gene Name: kelch-like family member 42
  ENST ID: ENST00000539176
  CDS Start-End: 284-1393
cctggcgccgcccgggagagcccgcgcgaggacgcccgccgcgctccgccggcccttttttggcgctgagggaaaggagaagggcagggccgccgcctcgcgggagcgggccccgggaggaggggccgccggagaggccgggcgagcgcgggcggccctcacctcgccgctcctcccgggccgccatccctcggcgccccgcccggaaccggcgcgcgcgtaggggctgggaggccggcgcgcagatctggcggtgagcgctgccgccccggggcccccagccatgtcggccgaggagatggtgcagatccgcctggaggaccgctgctacccggtgagcaagaggaagctcatcgagcagagcgactacttccgcgccctctaccgctccggcatgcgcgaggccctgagccaggaggccggcggcccggaggtgcagcagctgcgcggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagagacagcctctggagatcctgtgttgctacttgtcatgtttcttaggatcagctatcaagaataatctacttgctgcccagcctggcttctgtattaagtagtcgaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagc

SEQ ID NO: 145351 - DNA, 3425 bp, Homo sapiens
  Payload ID: 8732
  Gene Symbol: KLHL5
  Gene Name: kelch-like family member 5
  Uniprot ID: Q96PQ7
  ENST ID: ENST00000261425
  CDS Start-End: 153-2282
ctcccgcctggccgccccggcccgccgtgacccacggccgcctccggagcccgacgcgcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtca

SEQ ID NO: 145352 - DNA, 3300 bp, Homo sapiens
  Payload ID: 8732
  Gene Symbol: KLHL5
  Gene Name: kelch-like family member 5
  Uniprot ID: Q96PQ7
  ENST ID: ENST00000261426
  CDS Start-End: 76-2160
tgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataag

SEQ ID NO: 145353 - DNA, 3288 bp, Homo sapiens
  Payload ID: 8732
  Gene Symbol: KLHL5
  Gene Name: kelch-like family member 5
  Uniprot ID: Q96PQ7
  ENST ID: ENST00000381930
  CDS Start-End: 76-2349
tgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggtatggcattcatgtttcattattacactgactctctttttattaaaacaattcttatggtaaaacagatcccctcaatcttgtccaatactgaaatatatggcataaatatgacaatcacgttttgattagcgatgagaaaaagaggcaatgtttaattttataacataattaaaatccagaattacctttgagatgtaagttaatactcagagaaattattaattatctgctaccacttgcatgatgaagtgttctagcctgattaaagctgataggactactggagggctgcaacaatgggaggggagactggaaaataaaaacaaggatagtagtcagaaaactttgaacaacttgcccatgtgtgagcagtcggatttttaaatactcaacccattgatatctgggagcagattaaagtcctgataacctaatgaagatggcaaccctaaattacactgagtaagaaacctgatctggcagtcttactaacagaaagaatttcacccttgtgtatttctgggagggtctagcacttctaaaaatgatcttttgagatctttgcttccatcatcaccaagaacagaatcaggaatttgtgcttgtgtcacccagttcagtacttggtacataaaagacaataaatgtttaactgagccaagattttcttgtatacaaggagccatgataagtatggtcaagaaaacaaagcttctaggccaggcatggtggcttatgcctataatcccagcactttgggaggctgaggcgggcagatcacgaggtcaggagttcaagaccagcctgaccaatatggtgagaccccatctctactaaaaatacaaaaaaattagccgggcatggtggcacgtgcctgtaatcccagctactcggggggctgaggcaggagaatcgcttgaacccaggaggcagaggttgcagtgagcagagatcatgccactgcacttcagcctgggtgacagagtgagactccatctt

SEQ ID NO: 145354 - DNA, 2926 bp, Homo sapiens
  Payload ID: 8732
  Gene Symbol: KLHL5
  Gene Name: kelch-like family member 5
  Uniprot ID: Q96PQ7
  ENST ID: ENST00000508137
  CDS Start-End: 78-1784
ccgccgtgacccacggccgcctccggagcccgacgcggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtc

SEQ ID NO: 145355 - DNA, 2690 bp, Homo sapiens
  Payload ID: 8732
  Gene Symbol: KLHL5
  Gene Name: kelch-like family member 5
  Uniprot ID: Q96PQ7
  ENST ID: ENST00000504108
  CDS Start-End: 284-2551
actgcaacggggatagtgttttctgtctctgtcatttgtggtttaagaaaaagggggtggtgttctgcatttgaaaggactttaatgaatgctgtcagtgtttgtgagacctaatggtcagtatgggaaaggagagccgggaaagtggtctagctgcttcaggataggtggatgagagtttgctctgattgaacggaatgttccaccgtgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagata

SEQ ID NO: 145356 - DNA, 909 bp, Homo sapiens
  Payload ID: 8732
  Gene Symbol: KLHL5
  Gene Name: kelch-like family member 5
  ENST ID: ENST00000515612
  CDS Start-End: 1-847
ccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggtattttcacatacttttgaggacagcaaagatcacctggtggccatcaagcagaccatctggaggcaaaactccttatctgaggaattcagaagtcattagactgccctattatctaaagccggcatcttgtactaggcttctttaccaaaaatgtatttaat

SEQ ID NO: 145357 - DNA, 585 bp, Homo sapiens
  Payload ID: 8732
  Gene Symbol: KLHL5
  Gene Name: kelch-like family member 5
  ENST ID: ENST00000514399
  CDS Start-End: 1-109
agcagaagattgtggcggtgcacattggctggatagaccagaagtggatgatggcactagtgaagaagaaaatgaatctgattccagttcatgcagctctccagactaatatagagaatactaagtaacatgtctctaagatgacagctactaattcctgttaccttcactttcactgaaatgtgtgctatttagggaaatgaaggacattcctccaggagagtttaagggaatgtagaggggctagatgtgattatctggtgaaaaggggacaggaagaaggggaaatcagttagaagaaagaaaataaggaaaaaaataggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataa

SEQ ID NO: 145358 - DNA, 6298 bp, Homo sapiens
  Payload ID: 8733
  Gene Symbol: KLHL6
  Gene Name: kelch-like family member 6
  Uniprot ID: Q8WZ60
  ENST ID: ENST00000341319
  CDS Start-End: 37-1902
gggcctgcctgacacttgggcgctccttcagtctcgatgttgatggcaggacaaaggggcgcctggaccatgggtgatgtggtcgagaagagtttggaagggcccctggcaccttctacagatgagccctcccagaaaacaggagacttggtcgagatcttaaatggggaaaaggtcaaatttgacgacgcgggactctccttaattcttcagaatggcctggaaaccctgcgaatggaaaacgctctgacagatgtcatcttgtgtgtggacattcaggaattctcctgccaccgcgtggtgcttgccgcagccagcaactatttcagggccatgttctgcaacgatttaaaggaaaagtatgagaaaaggatcattattaaaggggttgatgctgagaccatgcacactctgttggactacacgtacaccagcaaggcgctgatcaccaagcagaatgtccagcgggtcctggaggctgctaacctcttccagttcctgcggatggtggatgcctgtgccagcttcctcactgaagccttgaacccagaaaactgcgttggaatactgaggctggctgacacacactcgctggacagtctaaagaagcaggttcagagttacatcattcaaaactttgtgcagattctgaactctgaggagtttcttgacctgcccgtggacactctgcaccacatcttgaagagtgatgacctttacgtgaccgaggaggctcaggtgtttgagaccgtgatgagctgggtccggcacaagccatcagaacgactctgcttactcccctatgtcctcgagaacgtgcgcttaccgcttctggacccgtggtactttgtggagacggtggaagcagatcctctcatcaggcagtgcccagaggtcttcccgctgctccaggaagccaggatgtaccacctttctggcaatgagatcatttcggaacgcaccaagcccaggatgcatgagttccagtctgaggtgttcatgatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcgatcaacaagtggattcagattgagtatttaaacataggccgctggaggcataagatggtggtgttgggtggcaaggtctatgtgatcggaggctttgacggcttacagagaatcaacaatgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccgggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgaccctcagcgtacccgcctcacctctcaccctcctccagtcccacttcaggcagcaggctcgagtttgaggccatacatcaggggatccccttgactcactttgggggaaccttggaagtcacagtttggggtcacttgagaccggccaggaatgtttgcatgacctacctcaggaggggaggcgaggaagagtaatatttagcattcaggacccacccaccctatgccggcttctgtgccaggcacttccttttatcggttcatttaacctggtgactggctcttatcacttctagtttacaggtgagggaaccaagtttcacagaggctaagtggcgtgcccctgatcactcagatagcaagtagctaccccaggagtctaaaatccaggtctttcatctccgaagtcaatgctctttccaccatgctgcctatctcagagcaggaaaaacaaacaaaaaacaacaacaaaacctggctcttgctgggcgtggcggctcacgcctgtaatcccagccctatgggaggctgaggcgggcggatgacctgaggtcaggagttcaagaccagcctggccaacatggtgagaccgccccgtctctactaaaaatacaaaaattagccgcgtgcagtggcaggcgcctgtaattccagctactcaggaggctgaggcaggaggatcacttgaacttgggaggtggaggttgcagtgagccgagatcgccacactgcactgcagcccgggaaacaaaagtgaagctctgtcttcaaaacaaaaacaaaaacaaaaacaaaaacaaagaaacctggctcatttcttgtttcggcaagtctgctaaaagattcactcagcacagcagggaaataaaggtgtttcctgctttctttccttttctttcttattctgcatcctccctcgtccccgccctttaccaatatttaaaccaaggagtcatttgggctccttgccaagaacatctcataggttcttccacttgaaaggtctgggggatgggcttgggaaggcctgtttgctttgaaagagatgaaatacttgtgttctgtcctcctcccattgaaaccctcttttttttttttttgagatgaagtcgcccaggctggagtgcagtggcatgatctcggctcactgcaacctctgtcaccctggttcaagtgattttcctgcctcagcctcctgagtagctgggattacaggcacctgccaccgcgcctggctaatttttgtagttttagtagagacggggtttcaccatcttggccaggctggtcttgaacgcctgaccttgtgatctgcccgcctcggcctcccgaagtgctgggattacaggtgtgagccactgggcccggtctttttttttttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcctacacaggagcgacagattctccttgatggtacactttctagtttttacacagtgatttaggtccacgttcctgataccccatcctcctgaagccttcgttttcaagacttttaaaaagcacttctacttggttttttgatcagtgtagctcaattgtgacttaaagaacagaatctgtccttcactgtaagagctacagctttcaaatgagctcactggaaattcattctaatccccaagctggagaaacaggttaagagatcctgtttcatatgctgtatttaaaaagcaacaatgataacaacatagtaactgcgttacccaatggactttattttcatcatatgatttcaattctctttatagagttttatttcatatccggtgtggcttgttcttttcagcagtttgggaagttagttattagagttgatagtgaattgaattttcattaaacagtcacggttagaagaagctaatatttgaaacagattttaaaaacttgaaaaattacaggtgagatttctgtttatgccagattattgaagataaatataaatgtatgttggtgtgtgaaatgctctgtgccttagaagcgtgacagttcagctctctgctgtggaaagtaacacagggcaatagaaacatatttgtggaattttagaacaaactattgctgactcatgagcactataataaccatcaggaagctcccaactgaagcaatgtaacagtgtaatctagttcaattcagcaaacattcatggagttcttcatgtctgtcaagccttgaggacacccacgaatggcaaatctccacgctagacactcaatacaggtaaataggccaccagttaatattcttgtttttattttcttcaagttagctaaaaatgagatgcgtatgaagtgaggaggctggatccaagtcttgattgcctttcagggggtcaaggtggtaagctgtgcagtgaagtcaaccagtggccatggcttacatgtttgtctctttgagatcgccaccagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacagatgcaaatgtgttatatacaa

SEQ ID NO: 145359 - DNA, 5453 bp, Homo sapiens
  Payload ID: 8733
  Gene Symbol: KLHL6
  Gene Name: kelch-like family member 6
  ENST ID: ENST00000468734
  CDS Start-End: 1-1833
atgggtgatgtggtcgagaagagtttggaagggcccctggcaccttctacagatgagccctcccagaaaacaggagacttggtcgagatcttaaatggggaaaaggtcaaatttgacgacgcgggactctccttaattcttcagaatggcctggaaaccctgcgaatggaaaacgctctgacagatgtcatcttgtgtgtggacattcaggaattctcctgccaccgcgtggtgcttgccgcagccagcaactatttcagggccatgttctgcaacgatttaaaggaaaagtatgagaaaaggatcattattaaaggggttgatgctgagaccatgcacactctgttggactacacgtacaccagcaaggcgctgatcaccaagcagaatgtccagcgggtcctggaggctgctaacctcttccagttcctgcggatggtggatgcctgtgccagcttcctcactgaagccttgaacccagaaaactgcgttggaatactgaggctggctgacacacactcgctggacagtctaaagaagcaggttcagagttacatcattcaaaactttgtgcagattctgaactctgaggagtttcttgacctgcccgtggacactctgcaccacatcttgaagagtgatgacctttacgtgaccgaggaggctcaggtgtttgagaccgtgatgagctgggtccggcacaagccatcagaacgactctgcttactcccctatgtcctcgagaacgtgcgcttaccgcttctggacccgtggtactttgtggagacggtggaagcagatcctctcatcaggcagtgcccagaggtcttcccgctgctccaggaagccaggatgtaccacctttctggcaatgagatcatttcggaacgcaccaagcccaggatgcatgagttccagtctgaggtgttcatgatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcgatcaacaagtggattcagattgagtatttaaacataggccgctggaggcataagatggtggtgttgggtggcaaggtctatgtgatcggaggctttgacggcttacagagaatcaacaatgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccgggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgaccctcagcgtacccgcctcacctctcaccctcctccagtcccacttcaggcagcaggctcgagtttgaggccatacatcaggggatccccttgactcactttgggggaaccttggaagtcacagtttggggtcacttgagaccggccaggaatgtttgcatgacctacctcaggaggggaggcgaggaagagtaatatttagcattcaggacccacccaccctatgccggcttctgtgccaggcacttccttttatcggttcatttaacctggtgactggctcttatcacttctagtttacaggtgagggaaccaagtttcacagaggctaagtggcgtgcccctgatcactcagatagcaagtagctaccccaggagtctaaaatccaggtctttcatctccgaagtcaatgctctttccaccatgctgcctatctcagagcaggaaaaacaaacaaaaaacaacaacaaaacctggctcttgctgggcgtggcggctcacgcctgtaatcccagccctatgggaggctggtcttgaacgcctgaccttgtgatctgcccgcctcggcctcccgaagtgctgggattacaggtgtgagccactgggcccggtctttttttttttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcctacacaggagcgacagattctccttgatggtacactttctagtttttacacagtgatttaggtccacgttcctgataccccatcctcctgaagccttcgttttcaagacttttaaaaagcacttctacttggttttttgatcagtgtagctcaattgtgacttaaagaacagaatctgtccttcactgtaagagctacagctttcaaatgagctcactggaaattcattctaatccccaagctggagaaacaggttaagagatcctgtttcatatgctgtatttaaaaagcaacaatgataacaacatagtaactgcgttacccaatggactttattttcatcatatgatttcaattctctttatagagttttatttcatatccggtgtggcttgttcttttcagcagtttgggaagttagttattagagttgatagtgaattgaattttcattaaacagtcacggttagaagaagctaatatttgaaacagattttaaaaacttgaaaaattacaggtgagatttctgtttatgccagattattgaagataaatataaatgtatgttggtgtgtgaaatgctctgtgccttagaagcgtgacagttcagctctctgctgtggaaagtaacacagggcaatagaaacatatttgtggaattttagaacaaactattgctgactcatgagcactataataaccatcaggaagctcccaactgaagcaatgtaacagtgtaatctagttcaattcagcaaacattcatggagttcttcatgtctgtcaagccttgaggacacccacgaatggcaaatctccacgctagacactcaatacaggtaaataggccaccagttaatattcttgtttttattttcttcaagttagctaaaaatgagatgcgtatgaagtgaggaggctggatccaagtcttgattgcctttcagggggtcaaggtggtaagctgtgcagtgaagtcaaccagtggccatggcttacatgtttgtctctttgagatcgccaccagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacaga

SEQ ID NO: 145360 - DNA, 969 bp, Homo sapiens
  Payload ID: 8734
  Gene Symbol: KLHL7
  Gene Name: kelch-like family member 7
  Uniprot ID: Q8IXQ5
  ENST ID: ENST00000322275
  CDS Start-End: 243-743
gggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggagaagcagaaaaagttgatcagagccttccagagtgtggtatgcttttcactgtgtgatgatccttagtggcacatgaatgaacgtccagatgtttgtgcagtagcccacccttatctgcaggatacgttccaagacccccagtgaatgcctgaaactgcagatagtactgaatcctatatatactgtgttttttatgatacatacatgcctatgatgaagtttaatttctaaattagacagtaaaagattaacaacaataataataaaatagaacaactttaa

SEQ ID NO: 145361 - DNA, 5620 bp, Homo sapiens
  Payload ID: 8734
  Gene Symbol: KLHL7
  Gene Name: kelch-like family member 7
  Uniprot ID: Q8IXQ5
  ENST ID: ENST00000339077
  CDS Start-End: 244-2004
cgggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaataggccactcagtttgttcttcaagtattttaggtaatggttgtttttagaatttgtgaaccagtgtctcttaattttcagttttctttatatagaggttataatagtcttaaaccctaaaaatgtttaaatcaaaaaggaattaggaaaaacataatgataggtatatttctatttgtgtagggttttttaatgtacagctttattgagatataattcacataccatacaattcaccatttaaagtatactattcaggccaggcacagtggctcacgcctgtaatcccagcactttgggaggccaaggtgggtagatcatttgaggtcagcagttcaagaccaccctggccaacatgatgagaccccgtctctactaaaaatacaaaaattagccaggcctggtggtgtgcacttgtaatcccagctattcaggagactgaggcaggaggattgcttgaacctgacaggcagaggttgcagtgagctgagatcaagccactgcaccccagcctgggcaacagagcaagactaaaaaaaaaaaaaaaaaaaaaaaaatgtattattcagtggtttttaatatatccacagagttacgcaaccatcaccacaattttagaacattttcatcaccccaaaaagaaaccttgtactgattagcaatggttccctatttcccccaacgcccctgtatttcctagggctaccataacaaactactgcaaacttggtggctttaaagaacagaaatttattctctcacaattcaggaagccagcactcctaaatcaagttgtcagcagggttagttccttctggagggtctgcagcagaaaccacacatgcctctcccctagcttctggtggttgccagcaatcctcagcattctttggcttgtagctgcagcacttcagtctctgtctctgtcttcgcatgggctttttccctgtgtgtctctgtatcttcacatggtgttcttataaggacaacataggagccagacacagtggctcaggccggtaatttcaacactttgggaggtggaggcagtaggatcacttgaggctaggagttcaagaccctgtctctacaaaaaaataaaaagttagcaggtgtggtatatacctgcagttctagctactcagaaggctgaggtgggaggatcacttgagcccaggagttcaaggatgtagtgagctatgattgtgccactgcactccagcctgggtgacagactgagaccctgtctcattaaaaaaaaaaaaaaaaaagctgggcgctgtgtctcacgcccttaatcccagcactttgggaggccgaggcgggtggattacctgaggtcaggagtttgagaccagcctggacaacatgccaaaaccccgtctctactaaaaatacaaaaattagccaggtatggtggtgtgcacctgtagtcccagctactcaggaggctgaggtaggagaattgcttgaacctgggaggcagaggttgcagtgagctgagattgcgccacttcattccagcctgggtgacagagcaagacaccttctcaaagcaaaatacaaacaaaaaaaggacaacatagggcccgcaatccagtatgaccttattttaattacacctgtaaagaccccatttccaaacgaggacacattctgagcttctggatagacatgaatttggggagatgctgttcaacacagaaaacctcccaaacaccatagccctaggcaaccactaatctactttctgtctctagatttgattattctgaacatttttagtagggttttcaattttgcactctattgaaaaatgtggctagtttaattttttgagagtgaaatatccatttattatattacaatatagctatataatttgacaatctcctatgtagaatatacagtacctgtctaagatattttaagtacaccagcatttccttttaggctatgtcaattgactagaacacactatagtaaatacatacacaggtttgatgtggattataatgaagtggtttttttccttagtaatctgtatcataattcccaattagtgtctttttctgccttggaaatttctacagaattgtcaatatcaggatagtgcgtaaaagtacactcaccatactgacaagcacattttctattttgttgcccaaaactccctgtcctgtaaagtgctctgcttgctttttagtagacatttgataagttaatgttatatcctttgcaatgatattattttgatgacaaagtaagtttatgctttcaaaaatcacaattcggtcagaaaagtttagcatcttaaaaaaattgttgctatttgaaaaaaacaaaacaaaacatatacttgtgactttgtggtccagctggcaaaaacttgacatatcatcccatgaaaattttaagtcatgaattattttgacatgacaatattgctaacaaaatcaaaatcagccgtttaataaacaattattccaccaa

SEQ ID NO: 145362 - DNA, 3231 bp, Homo sapiens
  Payload ID: 8734
  Gene Symbol: KLHL7
  Gene Name: kelch-like family member 7
  Uniprot ID: Q8IXQ5
  ENST ID: ENST00000409689
  CDS Start-End: 525-2141
cgcagttggtagaggggcgcgtaaaacaattctcgagcaaaagtgcttctcgtctgccgaggatgtagctcccaagtcagactcctgggggactcctcaggctggctttcgccgtcgggtatcggttgtgtaacagctctgccctagttatctctttgtggggcgaggatccttccattggcgagccgttttaaggtgccgtgagatcttgtgtgaagaaacccgttggcatagcccaaaccgaagcccccaaagggaggagagttgctggcctgacatcagctgctcttaaataaggatccccgccccctcctgtgttccccggtggagctagttgaagaggagtcctcctgttcgtgctaatttagagcagaagcagccatcgataaataccatgccatcttctaagggcactgtgcgcctctgttattaagaggagctctttgttctgtccttggtgtgtggtgcattcgtgaaattctgcagcacatcggcgaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgttttt

SEQ ID NO: 145363 - DNA, 1233 bp, Homo sapiens
  Payload ID: 8734
  Gene Symbol: KLHL7
  Gene Name: kelch-like family member 7
  Uniprot ID: Q8IXQ5
  ENST ID: ENST00000410047
  CDS Start-End: 575-1009
agttggtagaggggcgcgtaaaacaattctcgagcaaaagtgcttctcgtctgccgaggatgtagctcccaagtcagactcctgggggactcctcaggctggctttcgccgtcgggtatcggttgtgtaacagctctgccctagttatctctttgtggggcgaggatccttccattggcgagccgttttaaggtgccgtgagatcttgtgtgaagaaacccgttggcatagcccaaaccgaagcccccaaagggaggagagttgctggcctgacatcagctgctcttaaataaggatccccgccccctcctgtgttccccggtggagctagttgaagaggagtcctcctgttcgtgctaatttagagcagaagcagccatcgataaataccatgccatcttctaagggcactgtgcgcctctgttattaagaggagctctttgttctgtccttggtgtgtggtgcattcgtgaaattctgcagcacatcggcgaaagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggagaagcagaaaaagttgatcagagccttccagagtgtggtatgcttttcactgtgtgatgatccttagtggcacatgaatgaacgtccagatgtttgtgcagtagcccacccttatctgcaggatacgttccaagacccccagtgaatgcctgaaactgcagatagtactgaatcctatatatactgtgttttttatgatacatacatgcctatgatgaagtttaatttctaaattagacagtaaaagattaacaacaataataataaaatagaacaacttt

SEQ ID NO: 145364 - DNA, 418 bp, Homo sapiens
  Payload ID: 8734
  Gene Symbol: KLHL7
  Gene Name: kelch-like family member 7
  ENST ID: ENST00000414163
  CDS Start-End: 1-282
gtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaagttgaaaagagatgcatattcttctacacgagcctggaagtgagactgtaacttcagaattctcatttgttgtcttgccttgctcttataaatgagtcattcctaattgcactttgaaaatttatgggaaaatttaaataattgaggaatgaactaccaataaaaacattttcattcca

SEQ ID NO: 145365 - DNA, 3165 bp, Homo sapiens
  Payload ID: 8734
  Gene Symbol: KLHL7
  Gene Name: kelch-like family member 7
  ENST ID: ENST00000521082
  CDS Start-End: 270-392
aagtgcgcaggctcctgggcagggctcgggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaaccc

SEQ ID NO: 145366 - DNA, 5621 bp, Homo sapiens
  Payload ID: 8735
  Gene Symbol: KLHL8
  Gene Name: kelch-like family member 8
  Uniprot ID: Q9P2G9
  ENST ID: ENST00000273963
  CDS Start-End: 343-2205
gctcgcgggggctgaggcgagaggacgccaagcgcccgccggggctccgcggggccgcgcaggagagcgcgcgtccgccgggtgctcgcgcggggttggtgaggttccgctgagggcggccggggctctgggagcgtggtaacgtggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttgactgttgacaatgtccagcctctcttatatgcagcctgtattctgcaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctcaaaaaaaaaaaaaaaaaaaagataaaaaagcagaatcaatatgtgcacagttctctttatcaggcaaaaacacgtttattgagacatgaaatgagaatcaggctgaaggaatcatgcagctgaaagatgattatattcatagaaatgaagagatgaaatattcaaagaagatggctactttattgtgagacttaccactttaacctcatatgttaacagcacctaccaaaaaatgatatgagatagagctaaaatactgaaattgcaaatggacaaaataaatcatgaaaatttgtttattatttcttcaataaatatttctaggtgctttgtgattctttcatttagtcattaaagccattgctttactatattgcgttgccactttaaaaacaagttacttgacattgtttttgacagatttcactatatacttatgtaattaattgattatttctaaaatgtttgaataaactttgtactccctctaaggagtattttattcattcttttaattcccaaatgaactttgaacttacagtgctgttgaatgccttggtaaggacttcttgaaattgcataaactattcttgtaaatggtaaacttgagaattttctttgtttcttttttctctatgtcttaaagaatgcctttagaatctaattcatgttgtatcagttaagaatgtttctgtggtttctcgtatcagatgtgtaaagaaattattactgggatgccattggctatgtctctttccccttcatgtaaaattccaagtgtcagtaaaacttctctataatattttcttaaaaccatttataaatttgtgttataatactccagaaaatcaatgtaataagtggtcatatatatcaccaactatggatatcaaaaagttggggtcacatcagtgctatttatttaattaaaatacattgcatatttctattagcacaaa

SEQ ID NO: 145367 - DNA, 4049 bp, Homo sapiens
  Payload ID: 8735
  Gene Symbol: KLHL8
  Gene Name: kelch-like family member 8
  ENST ID: ENST00000425278
  CDS Start-End: 260-1573
gctcgcgcggggttggtgaggttccgctgagggcggccggggctctgggagcgtggtaacgtggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctcaaaaaaaaaaaaaaaaaaa

SEQ ID NO: 145368 - DNA, 3245 bp, Homo sapiens
  Payload ID: 8735
  Gene Symbol: KLHL8
  Gene Name: kelch-like family member 8
  Uniprot ID: Q9P2G9
  ENST ID: ENST00000512111
  CDS Start-End: 386-2248
aaattcgagccctcgtgcaccaaccgaaactccacagctgagagggcttggggcccggacagcaggagatccagcccctgagcaaccttccacggcttttgtcgcccccattggcgggaggagcagggttatgctcccggctcccgtaggggagctccagcctctggctctgtcagcctccccggcagctccttgactccttcctcccagtctttcgaagaggggcccaggcagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttggctcaaagctaatctcttgtcacaagctggtattggcttgtgttattccctactttagagccatgtttctttctgaaatggctgaagccaagcaaacgctgattgagattagagattttgatggtgatgcaatagaagacttggtaaagtttgtctattcttcacggctcactttgactgttgacaatgtccagcctctcttatatgcagcctgtattctgcaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttac

SEQ ID NO: 145369 - DNA, 2399 bp, Homo sapiens
  Payload ID: 8735
  Gene Symbol: KLHL8
  Gene Name: kelch-like family member 8
  ENST ID: ENST00000506985
  CDS Start-End: 198-431
ggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaa

SEQ ID NO: 145370 - DNA, 5175 bp, Homo sapiens
  Payload ID: 8735
  Gene Symbol: KLHL8
  Gene Name: kelch-like family member 8
  Uniprot ID: Q9P2G9
  ENST ID: ENST00000498875
  CDS Start-End: 271-1905
gtccgccgggtgctcgcgcggggttggtgaggttccgctgagggcggccggggctctgggagcgtggtaacgtggctgcaaccttagcgacatcaggaagaacagggtcgaggatcgagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggttgaactggtggctagagcttgttgtgaatacatgaagttacattttcatccctccaattgcctggcagtaagagcctttgcagaaagtcacaatcgaatagacttaatggacatggcggatcagtatgcctgtgaccattttactgaagtagtggagtgtgaagactttgtaagtgtatcaccgcagcacctccataagcttttgtcctccagtgatctaaatattgaaaatgaaaagcaggtctataatgctgccatcaagtggcttcttgccaatcctcagcatcattccaaatggttggatgaaacacttgcacaggttcgcctgccattgttgccggttgattttcttatgggtgttgtggcaaaagaacagattgtcaagcaaaatctaaaatgtagagatttactggatgaagcaagaaattaccaccttcacttgagtagcagagcagtacctgactttgaatactccattcggactaccccaaggaagcatactgctggtgtgctgttttgtgtaggtggtcgaggtggatctggtgacccctttcgcagtattgaatgctattctatcaacaaaaacagttggttctttggaccagaaatgaatagtcgaaggcgacatgtgggtgtaatctctgtggaaggtaaagtgtatgcagtaggtggacatgatggaaatgaacatttagggagtatggagatgtttgatcctctcactaataaatggatgatgaaggcatcaatgaacacaaagaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtaaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtggttttgatgataattctcctctgagttcagttgagcggtatgacccccgaagcaacaagtgggattatgtggcagcacttactactcccagaggtggagtgggaatcgcaacagtgatgggcaaaatctttgcagttggtggtcataatggcaatgcatacttaaatacagtagaagcgtttgatccagtgctgaataggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccacatcacaaaaaaaagccagtgcctattgagtatatcaaaccaaaaaagaaaaaaaaaagttttaagaggggtcaggctggcagataaaagtctcttatgaagcagatataaatccagtaagctatttttttctacctatgggcaagttcataagtcattgctggatctgaaccagtgttcttttgtgtaagtacaaccatatttcagtcagtccagaggcagttaaccctgtagcacttactagactggtgacaactggctggatgtggagaataagtgtcaaaacctggcttcaatgtctatttcttatgtctaatggagttcttatattacagtgtttgtttagctatggttactaatatgtttgttatatttattttcggggagaggatcttgttattgtttcctgagattatttaaaatgttttttctttgatgtatttctgtctttcttatatgtaaggagttataagggttattatattttcatttctggtttttactatacaatggttatctaacatactaagttggtaccctacctacccgtaaaatatgaaatactcagaagtaaagtgtgtgggcaatcagaagcatagccttgaaggacctgacagcagtatgaaaagataaataggccaggcatggtggctcacgcctgtgatcccagcactttgggaggccgaggtgggtggaccacctgagatcaggtgttcaagaccagcctgaccaacatggtgaaaccctgtctctactaaaagtacaaaaattagccaggcgtggtggcgcatacctgtaattccagctactcaggaggctgaggcaggagaattgcttgaacccaggaggtggaggttgcaatgagccgaggttgagccatcgcactccagcggtgaaacaagagtgaaactccatctcaaaaaaaaaaaaaaaaaaaagataaaaaagcagaatcaatatgtgcacagttctctttatcaggcaaaaacacgtttattgagacatgaaatgagaatcaggctgaaggaatcatgcagctgaaagatgattatattcatagaaatgaagagatgaaatattcaaagaagatggctactttattgtgagacttaccactttaacctcatatgttaacagcacctaccaaaaaatgatatgagatagagctaaaatactgaaattgcaaatggacaaaataaatcatgaaaatttgtttattatttcttcaataaatatttctaggtgctttgtgattctttcatttagtcattaaagccattgctttactatattgcgttgccactttaaaaacaagttacttgacattgtttttgacagatttcactatatacttatgtaattaattgattatttctaaaatgtttgaataaactttgtactccctctaaggagtattttattcattcttttaattcccaaatgaactttgaacttacagtgctgttgaatgccttggtaaggacttcttgaaattgcataaactattcttgtaaatggtaaacttgagaattttctttgtttcttttttctctatgtcttaaagaatgcctttagaatctaattcatgttgtatcagttaagaatgtttctgtggtttctcgtatcagatgtgtaaagaaattattactgggatgccattggctatgtctctttccccttcatgtaaaattccaagtgtcagtaaaacttctctataatattttcttaaaa

SEQ ID NO: 145371 - DNA, 5710 bp, Homo sapiens
  Payload ID: 8736
  Gene Symbol: KLHL9
  Gene Name: kelch-like family member 9
  Uniprot ID: Q9P2J3
  ENST ID: ENST00000359039
  CDS Start-End: 522-2375
ggaaggagcggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcaggtgatgaatcatctgtctaataatcagatttgaggtccacagccctttgtggtcctgctacagggtgattttcagtggatgactgactggcgtggcccgaggggtgccgcagtgactgccttcccttgataaggaaacgagctttctgttctttctggacacctcgttacctgtaaaacattccggttataacttctttatccggcttgcatctctgtgcaagaggaaagctttcacatgaaagtgtcccttggtaacggcgaaatgggcgtctctgcccatttgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttgcatttgcttgcatttatttcttccctcaatctgttgtagttttacaaaggcaacgctgttcagttaatttttgagatcaaatttgtctttttttttttttgagacagggtctcactgttgtgcagtctggagtgcaatggcacgatgtgtgctcactgaaacctctgcctctcatgttcaggcgattctcccacctcagcctcccgattagctgggattacaggcatgtaccaccaagcccggctaattttgtatttttagtagagatggggttaggggataattttgatatggtttattttttatgtagtatttcagtgcttattctgacatatcaaggtgatactgccctgcctctattttgtacaggcttttccttttattgaaaaaaagtactttttattacatcttatgtctgaacctggtgcttcctattgaaataagtattgctttactaggtaaactgctctatctacatcccccacctccagcttcacccaccctgcctctcatttttttactttcccgtattctgcagttgacagttctcttggtaatcatacaggtagctgactaatgctatgctaatacaggttgagcagccctaatccaaaaatccaaattgctccaaaatttaaaactttttgagggccaacaggatgccacaagtagaaaattccacaccagagctcatgtgacaggttacactcaaaacacagtgaagacttgtttcatgcacaacattattaagactattataattaccttcagactacgtgtctgaaacgtgaaatataaccgaagttttaagtaatattgtttagacttgggtccctcccccaggatacgtcatgtacatgcaaatattccaaaatccaaaacacttctggtcccaagcatttcagataagggatattcaatctgtactgctcattaaacctggagtttcttatagagagaaattttaggtggttgaaatgattaaatggaaagagatttattttcataagctggtaattttttaaagaaagttcagactggaaaaatatttagaggataaaaactaaaagcacataaagcattatgttaacatttcttgttttagtttttcggaaagtattcaaaaattaacatttgttagcttttttgatatgtctattatagaacgtacaggaaaataaaagcaaactaatttatcagtgattccacatgttgaagataatttctattaatagtatattatatatatatatatacgtacatatgtgcaggcatttgtcaaatatttttcaagtatgccagaccttaggctaaaagctggataatgaaaataaatccaccttccaaaga

SEQ ID NO: 145372 - DNA, 2812 bp, Homo sapiens
  Payload ID: 8737
  Gene Symbol: KEL
  Gene Name: Kell blood group, metallo-endopeptidase
  Uniprot ID: P23276
  ENST ID: ENST00000355265
  CDS Start-End: 476-2674
attttgtcatcgcaacactaaacctttgtcggtctggtgctccccaattcatgaattgcttcttacttaaataaactctttaaaattttactgtgcctcatattttttttaatacagaagaaatgagagaaggaagaatattttagaaataaaggaacttcatgggcagagtcacagtgcaagacaaaaggagcagaccaagggcaagattgcttggggagtgaagactccctccctcttctcccctgagaagctgagataaagggggaggagaagcctgggtgccccccactgataagcaggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagatagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatgcctgcccgcccacgatggatgaagtgcgtggaggagacaggcacgttcttcgagcccacgctggcggctttgtttgttcgtgaggcctttggcccgagcacccgaagtgctgccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagagccgtgaactttggcgctgctggcagcatcatggcccacgagctgttgcacatcttctaccagctcttactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaa

SEQ ID NO: 145373 - DNA, 556 bp, Homo sapiens
  Payload ID: 8737
  Gene Symbol: KEL
  Gene Name: Kell blood group, metallo-endopeptidase
  ENST ID: ENST00000460479
  CDS Start-End: 1-556
gcaaaagtcctgcccccactggaggggagggaatgaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggag

SEQ ID NO: 145374 - DNA, 649 bp, Homo sapiens
  Payload ID: 8737
  Gene Symbol: KEL
  Gene Name: Kell blood group, metallo-endopeptidase
  ENST ID: ENST00000476829
  CDS Start-End: 96-649
gaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagatctttcgggaatacctgacttacctgaa

SEQ ID NO: 145375 - DNA, 786 bp, Homo sapiens
  Payload ID: 8737
  Gene Symbol: KEL
  Gene Name: Kell blood group, metallo-endopeptidase
  ENST ID: ENST00000467543
  CDS Start-End: 175-786
agaagtgccccttctccaggatcaaggaactggggcggggggtgtttcctggaccccagtcctccgaatcagctcctagagtggaaccaggaaggattctggagccacagaagatagacagatggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatc

SEQ ID NO: 145376 - DNA, 2812 bp, Homo sapiens; identical to SEQ ID NO: 145372
  Payload ID: 8737
  Gene Symbol: KEL
  Gene Name: Kell blood group, metallo-endopeptidase
  Uniprot ID: P23276
  ENST ID: ENST00000615381
  CDS Start-End: 476-2674

SEQ ID NO: 145377 - DNA, 556 bp, Homo sapiens; identical to SEQ ID NO: 145373
  Payload ID: 8737
  Gene Symbol: KEL
  Gene Name: Kell blood group, metallo-endopeptidase
  ENST ID: ENST00000631527
  CDS Start-End: 1-556

SEQ ID NO: 145378 - DNA, 786 bp, Homo sapiens; identical to SEQ ID NO: 145375
  Payload ID: 8737
  Gene Symbol: KEL
  Gene Name: Kell blood group, metallo-endopeptidase
  ENST ID: ENST00000632261
  CDS Start-End: 175-786

SEQ ID NO: 145379 - DNA, 649 bp, Homo sapiens; identical to SEQ ID NO: 145374
  Payload ID: 8737
  Gene Symbol: KEL
  Gene Name: Kell blood group, metallo-endopeptidase
  ENST ID: ENST00000633704
  CDS Start-End: 96-649

SEQ ID NO: 145380 - DNA, 2451 bp, Homo sapiens
  Payload ID: 8738
  Gene Symbol: KRT1
  Gene Name: keratin 1, type II
  Uniprot ID: P04264
  ENST ID: ENST00000252244
  CDS Start-End: 60-1994
agaggagtgtttagctccttcccttactctaccttgctcctacttttctctaagtcaacatgagtcgacagtttagttccaggtctgggtaccgaagtggagggggcttcagctctggctctgctgggatcatcaactaccagcgcaggaccaccagcagctccacacgccgcagtggaggaggtggtgggagattttcaagctgtggtggtggtggtggtagctttggtgctggtggtggatttggaagtcggagtcttgttaaccttggtggcagtaaaagcatctccataagtgtggctagaggaggtggacgtggtagtggctttggtggtggttatggtggtggtggctttggtggtggtggctttggtggtggtggctttggtggaggtggcattgggggtggtggctttggtggttttggcagtggtggtggtggttttggtggaggtggctttgggggtggtggatatgggggtggttatggtcctgtctgccctcctggtggcatacaagaagtcactatcaaccagagccttcttcagcccctcaatgtggagattgaccctgagatccaaaaggtgaagtctcgagaaagggagcaaatcaagtcactcaacaaccaatttgcctccttcattgacaaggtgaggttcctggagcagcagaaccaggtactgcaaacaaaatgggagctgctgcagcaggtagatacctccactagaacccataatttagagccctactttgagtcattcatcaacaatctccgaaggagagtggaccaactgaagagtgatcaatctcggttggattcggaactgaagaacatgcaggacatggtggaggattaccggaacaagtatgaggatgaaatcaacaagcggacaaatgcagagaatgaatttgtgaccatcaagaaggatgtggatggtgcttatatgaccaaggtggaccttcaggccaaacttgacaacttgcagcaggaaattgatttccttacagcactctaccaagcagagttgtctcagatgcagactcaaatcagtgaaactaatgtcatcctctctatggacaacaaccgcagtctcgacctggacagcatcattgctgaggtcaaggcccagtacgaggatatagcccagaagagcaaagctgaggccgagtccttgtaccagagcaagtatgaagagctgcagatcactgctggcagacatggggatagtgtgagaaattcaaagatagaaatttctgagctgaatcgtgtgatccagagacttagatctgaaatcgacaatgtcaagaagcagatctccaacttgcagcagtccatcagtgatgcagagcagcgtggcgagaatgccctcaaggatgccaagaacaagctgaatgacctggaggatgccctgcagcaggccaaggaagacctggcccgcctgctgcgcgactaccaggagctgatgaacacaaagctggccctggatctggagattgccacctacaggaccctcctggagggagaagaaagcaggatgtctggagaatgtgccccgaacgtgagtgtgtctgtgagcacaagccacaccaccatcagtggaggtggcagccgaggaggtggcggcggtggctacggctctggaggtagcagctatggctccggaggtggtagctatggttctggaggtggcggcggcggcggccgtggcagctatggctccggaggtagcagctacggctccggaggtggcagctatggctctggaggtggcggcggcggccatggcagctacggctccggaagcagcagtgggggctacagaggtggctctggaggcggcggcggcggcagctctggcggccggggctctggcggcgggagctctggaggctccataggaggccggggatccagctctgggggtgtcaagtcctctggtggcagttccagcgtgaagtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagtcccctggctatgaccctgctttgttctttccctgagaaacagttcagcagtgaccaccacccacatgacatttcaaagcacctccttaagccagccagagtaggaccagttagacccagggtgtggacagctccttagcatcttatctctgtgctgttttggttttgtacataaggtgtaagcaagttgtttttcttttgtggagaggtcttaaactccccatttccttgttttgctgcaataaactgcatttgaaattc

SEQ ID NO: 145381 - DNA, 2124 bp, Homo sapiens
  Payload ID: 8739
  Gene Symbol: KRT10
  Gene Name: keratin 10, type I
  Uniprot ID: P13645
  ENST ID: ENST00000269576
  CDS Start-End: 11-1765
cagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcatctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggccacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaacta

SEQ ID NO: 145382 - DNA, 1867 bp, Homo sapiens
  Payload ID: 8740
  Gene Symbol: KRT12
  Gene Name: keratin 12, type I
  Uniprot ID: Q99456
  ENST ID: ENST00000251643
  CDS Start-End: 25-1509
agttgtggccaccttccccaggccatggatctctccaacaacaccatgtcactctcagtgcgcacccccggactgtcccggcggctctcctcgcagagtgtgataggcagacccaggggcatgtctgcttccagtgttggaagtggttatgggggaagtgcctttggctttggagccagctgtgggggaggcttttctgctgcttccatgtttggttctagttccggctttgggggtggctccggaagttccatggcaggaggactgggtgctggttatgggagagccctgggtggaggtagctttggagggctggggatgggatttgggggcagcccaggaggtggctctctaggtattctctcgggcaatgatggaggccttctttctggatcagaaaaagaaactatgcaaaatcttaatgatagattagcttcctacctggataaggtgcgagctctagaagaggctaatactgagctagaaaataaaattcgagaatggtatgaaacacgaggaactgggactgcagatgcttcacagagcgattacagcaaatattatccactgattgaagacctcaggaataagatcatttcagccagcattggaaatgcccagctcctcttgcagattgacaatgcgagactagctgctgaggacttcaggatgaagtatgagaatgaactggccctgcgccagggcgtagaggccgacatcaatggcctgcgccgggtgctggacgagctgaccctgaccaggaccgacctggagatgcagatcgagagcctgaacgaggagctggcctacatgaagaagaaccacgaggatgagctccaaagcttccgggtgggcggcccaggcgaggtcagcgtagaaatggacgctgcccccggagtggacctcaccaggctcctcaatgatatgcgggcgcagtatgaaaccatcgctgagcagaatcggaaggacgctgaagcctggttcattgaaaagagcggggagctccgtaaggagattagcaccaacaccgagcagcttcagtccagcaagagcgaggtcaccgacctgcgtcgcgcctttcagaacctggagatcgagctacagtcccagctcgccatgaagaaatccctggaggactccttggccgaagccgagggcgattactgcgcgcagctgtcccaggtgcagcagctcatcagcaacctggaggcacagctgctccaggtgcgcgcggacgcagagcgccagaacgtggaccaccagcggctgctgaatgtcaaggcccgcctggagctggagattgagacctaccgccgcctgctggacggggaggcccaaggtgatggtttggaggaaagtttatttgtgacagactccaaatcacaagcacagtcaactgattcctctaaagacccaaccaaaacccgaaaaatcaagacagttgtgcaggagatggtgaatggtgaggtggtctcatctcaagttcaggaaattgaagaactaatgtaaaatttcacaagatctgccccatgattggttccttaggaacaagaaatttacaagtagaaattattcctttcagagtaacatgctgtattacttcaatccctatttttgtctgttccattttctttggattccctattcacattgaatcctttttgcccttctgaaacaatattcagtcacaagtcattttggtcatgttggtctttgtaacaaatcaaaattaccttatatccttctggacctggagtagtcttttaacgaactttcttctggtaacccggaatattttttaatcatagagctttaatcaagtagtattgttttaatagagttaattgtaataaaagatgaatggtaa

SEQ ID NO: 145383 - DNA, 1867 bp, Homo sapiens; identical to SEQ ID NO: 145382
  Payload ID: 8740
  Gene Symbol: KRT12
  Gene Name: keratin 12, type I
  Uniprot ID: Q99456
  ENST ID: ENST00000572470
  CDS Start-End: 25-1509

SEQ ID NO: 145384 - DNA, 1699 bp, Homo sapiens
  Payload ID: 8741
  Gene Symbol: KRT13
  Gene Name: keratin 13, type I
  Uniprot ID: P13646
  ENST ID: ENST00000246635
  CDS Start-End: 48-1424
ggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtccgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttccggtcggatctctctcctctctgacctggatacgctttggtttctcaacttctctaccccaaagaaaagattattcaataaagtttcctgcctttctgcaaacata

SEQ ID NO: 145385 - DNA, 1673 bp, Homo sapiens
  Payload ID: 8741
  Gene Symbol: KRT13
  Gene Name: keratin 13, type I
  Uniprot ID: P13646
  ENST ID: ENST00000336861
  CDS Start-End: 48-1310
ggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtccgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttccggtcggatctctctcctctctgacctggatacgctttggtttctcaacttctctaccccaaagaaaagattattcaataaagtttcctgcctttctgcaaacata

SEQ ID NO: 145386 - DNA, 572 bp, Homo sapiens
  Payload ID: 8741
  Gene Symbol: KRT13
  Gene Name: keratin 13, type I
  ENST ID: ENST00000590425
  CDS Start-End: 78-572
agttggcaccaagtcagagggtggggaagggaggagagaagataaccagcccctatggaggtgtataaaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgc

SEQ ID NO: 145387 - DNA, 1219 bp, Homo sapiens
  Payload ID: 8741
  Gene Symbol: KRT13
  Gene Name: keratin 13, type I
  ENST ID: ENST00000464634
  CDS Start-End: 63-254
acagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcgatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtaggtcctctccagcctctttcttaggatagtgactgcaggacccgtgggtgtcagagcaggcagggccttagagatccaccccctcatgtcagagaggagacccctcactgtctgactttac

SEQ ID NO: 145388 - DNA, 549 bp, Homo sapiens
  Payload ID: 8741
  Gene Symbol: KRT13
  Gene Name: keratin 13, type I
  ENST ID: ENST00000587435
  CDS Start-End: 64-549
cacagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtccgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggagatgcagatcgagagcctgaatgaagagctagcctacatgaagaagaaccatgaagaggagatgaaggaatttagcaaccaggtggtc

SEQ ID NO: 145389 - DNA, 1456 bp, Homo sapiens
  Payload ID: 8741
  Gene Symbol: KRT13
  Gene Name: keratin 13, type I
  ENST ID: ENST00000587544
  CDS Start-End: 64-1311
cacagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtccgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacaccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtaggtcctctccagcctctttcttaggatagtgactgcaggacccgtgggtgtcagagcaggcagggccttagagatccaccccctcatgtcagagaggagacccctcactgtctgactttacggggacatttccttggtaggctgca

SEQ ID NO: 145390 - DNA, 1662 bp, Homo sapiens
  Payload ID: 8742
  Gene Symbol: KRT14
  Gene Name: keratin 14, type I
  Uniprot ID: P02533
  ENST ID: ENST00000167586
  CDS Start-End: 88-1506
aaagcactcgcatccctttccaatttacccgagcaccttctcttcactcagccaactgctcgctcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctgcgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 145391 - DNA, 5237 bp, Homo sapiens
  Payload ID: 8743
  Gene Symbol: KRT15
  Gene Name: keratin 15, type I
  Uniprot ID: P19012
  ENST ID: ENST00000254043
  CDS Start-End: 3587-4957
aaatgtactcagcaccctgctaaggaggctggagaccccatcacggccatggcaatcccgaaggaggagctgtttcaaggttggttatgaacatgtaaccccagagccccgctgctgtagcctggactgggacccccttctgccccctccctagctgtcctgttctggcctccagcacccacaaaccaccacccccaacttaacttctcaggaagccttggagctggagggagaggcctggctgcacccccagctgggactgcccagaggcgcttgtccctgcccatgaaagcctcccttgtcacagctgaaaccttccctctgcctcaggggcccctggaatgtggctgcggggcggggtctgggcccacacaggtggggcaggtgactgtcaggtctcaggcctgagtgtcaggaatgaagcctgcctttgtgtgtgcacagtgcagggtggggctggactggggacacttttctgtctcagcctggagacctgggataggagggagaggggagtggggaagttgaggggagtgcctttacatcctgctggtcatcgtggccacttcagtctgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaaggtaagtctctgggctccaggacacaccccctctccctggcatttccctggggaacaggagaggtgtgggagggttctaaggttgttggagacttcattctccttgtgccctcaaatgctcactatggccctgaggggagtctgtgttaatggcctaagtttaaatcaggaaccaggctcagagaggctgagtctctttccactgggctgcactgcctcattctaaggagaaaaggccagctccacagatggccccatctggctgcagtgggcaaaggtcagaaactggcacagcatcctgggcaggctgcctggggcagggcccggggctacagcctgggctggggccagacagagctttatcttcgcaaggccatcccacctggtgctaatgaggaggctccgggccccacccagatctggagctcacagtagcggtttggactgaaaccagggatttgtgcgtggggcagtgaggggggcagctgccgcccctggcctgggcctgagagtatagagaaagccacctcgaggggctgctggaggagagtcaggtgcagaaggggatctggctggggtccagcccttcctcaccctggggtgaaaggcgagtaattgttcttgagttaattgctggggccacaatgtctgcagaggcttttaatgagctctggatgatctgagtttgattatttttctttcggaggaaaagacaataccctcccacccatgagacaataccacactgtctgtgcccagcattggaggccaggctcactgcgaagatggatgagaaggaacccacccccagccttgctggctggcagttccccttgccagcccagctcagatgcaggaatttggggtctgcaggaaggactctttccctgtgccctgtttggttgagggtgtgaggacctgtttgagtcctggctttgccccttaccagtggtgccacctggcacaagttgcttcacctctccaagtttcaatttcattctttctgaatcttgggtgggggtcaccctctgttgtgaggatgagaggaggtgatggatgcaaaagtgctttgtaaatcacaaagtgcagggtagaagtaaaggattatgctattatagcaaaataagaacctaagaacaacctgcgttgccccataggagctggctatggaaggtcgatgccgttgagcctaagaacatgctcaggctcacagggcatgttctgatgcccaacgacaaagcccctcctggtgagggcactcaggcgcaggtgccggtcatgcaccctggcccctgcatgtctggcacctgggtggggatccaggagggggcaggatgggggctcttgggccacagggcttccctggaagtgagagttgagagcgccccttgccacagggaaacagagacttaaaaaggtaaatgtccacagtcttaccatggtaattggtagggtcaggatttgaacccaggcctcacagtcttaccatgataattgataaagccaggattcaaacccgggcctgagggactccagagccctgtccacttcaccatgctgcaacctgggctaggaatcctcctcctgagtttctgtaagccctggggccaggtccagagggctgagccacacctccaagtggcactgcccacaggtatcaggtgtccctggaaaggtgtccctgagctggtggcagagaaaagggctctcctgagtgttcaactccccgtctgtgtgaagcaatgccttggtcttcaagatctccggtgtcttccagcctgcctgccagtctcccttctcttcccttccacagcattcaggcacatagagccttctgcagcggcccgtccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcattcactcactcactcactcacagggttttgagttggataacacagcataatgatcggccagtggactcccaaactaagaacacggagctgtcctcttggggagaggctcagggctcggggaagtgaagtccagctgagggcacagttggcctgagctgctctcagtacaggcagaggccttggtagctgtgctgtgatgagagttcgctccctgctgctctcttctggcatggagagatgaacctgtaatccaagtgttaaaaccgtgccctggggaaaaacactattaattctgaatcatctcttttgttgcattaaaaaaaaatagaagagaaaaacttcacatgacccactcaaggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattgccatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaatatc

SEQ ID NO: 145392 - DNA, 3758 bp, Homo sapiens
  Payload ID: 8743
  Gene Symbol: KRT15
  Gene Name: keratin 15, type I
  ENST ID: ENST00000393974
  CDS Start-End: 2605-3480
agctctggatgatctgagtttgattatttttctttcggaggaaaagacaataccctcccacccatgagacaataccacactgtctgtgcccagcattggaggccaggctcactgcgaagatggatgagaaggaacccacccccagccttgctggctggcagttccccttgccagcccagctcagatgcaggaatttggggtctgcaggaaggactctttccctgtgccctgtttggttgagggtgtgaggacctgtttgagtcctggctttgccccttaccagtggtgccacctggcacaagttgcttcacctctccaagtttcaatttcattctttctgaatcttgggtgggggtcaccctctgttgtgaggatgagaggaggtgatggatgcaaaagtgctttgtaaatcacaaagtgcagggtagaagtaaaggattatgctattatagcaaaataagaacctaagaacaacctgcgttgccccataggagctggctatggaaggtcgatgccgttgagcctaagaacatgctcaggctcacagggcatgttctgatgcccaacgacaaagcccctcctggtgagggcactcaggcgcaggtgccggtcatgcaccctggcccctgcatgtctggcacctgggtggggatccaggagggggcaggatgggggctcttgggccacagggcttccctggaagtgagagttgagagcgccccttgccacagggaaacagagacttaaaaaggtaaatgtccacagtcttaccatggtaattggtagggtcaggatttgaacccaggcctcacagtcttaccatgataattgataaagccaggattcaaacccgggcctgagggactccagagccctgtccacttcaccatgctgcaacctgggctaggaatcctcctcctgagtttctgtaagccctggggccaggtccagagggctgagccacacctccaagtggcactgcccacaggtatcaggtgtccctggaaaggtgtccctgagctggtggcagagaaaagggctctcctgagtgttcaactccccgtctgtgtgaagcaatgccttggtcttcaagatctccggtgtcttccagcctgcctgccagtctcccttctcttcccttccacagcattcaggcacatagagccttctgcagcggcccgtccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcattcactcactcactcactcacagggttttgagttggataacacagcataatgatcggccagtggactcccaaactaagaacacggagctgtcctcttggggagaggctcagggctcggggaagtgaagtccagctgagggcacagttggcctgagctgctctcagtacaggcagaggccttggtagctgtgctgtgatgagagttcgctccctgctgctctcttctggcatggagagatgaacctgtaatccaagtgttaaaaccgtgccctggggaaaaacactattaattctgaatcatctcttttgttgcattaaaaaaaaatagaagagaaaaacttcacatgacccactcaaggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattgccatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaata

SEQ ID NO: 145393 - DNA, 2394 bp, Homo sapiens
  Payload ID: 8743
  Gene Symbol: KRT15
  Gene Name: keratin 15, type I
  Uniprot ID: P19012
  ENST ID: ENST00000393976
  CDS Start-End: 747-2117
gcacagctggtaaatgggaaaagaggggtttaaagcattcaggcacatagagccttctgcagcggcccgtccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcattcactcactcactcactcacagggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattgccatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaat

SEQ ID NO: 145394 - DNA, 903 bp, Homo sapiens
  Payload ID: 8743
  Gene Symbol: KRT15
  Gene Name: keratin 15, type I
  ENST ID: ENST00000458290
  CDS Start-End: 242-903
gaagaggccccaaaagaagtcccacttcttcctggtggagaggtgagggctgcaggcccaaccctatgagtgatgggggcaagtgagggacactagttccacgcccgcatgctgccaaatgtactcagcaccctgctaaggaggctggagaccccatcacggccatggcaatcccgaaggaggagctgtttcaaggtacgtgccctggaggaggccaatgctgacctggaggtgaagatccatgactggtaccagaagcagaccccaaccagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaa

SEQ ID NO: 145395 - DNA, 959 bp, Homo sapiens
  Payload ID: 8743
  Gene Symbol: KRT15
  Gene Name: keratin 15, type I
  ENST ID: ENST00000497016
  CDS Start-End: 472-717
ggagtggggaagttgaggggagtgcctttacatcctgctggtcatcgtggccacttcagtctgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaagcattcaggcacatagagccttctgcagcggcccgtccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaag

SEQ ID NO: 145396 - DNA, 780 bp, Homo sapiens
  Payload ID: 8743
  Gene Symbol: KRT15
  Gene Name: keratin 15, type I
  ENST ID: ENST00000470004
  CDS Start-End: 182-331
catcttgctccaactgagagtcaggctgagctggagttatttccattttcctgattggtagactaaggctcagagagaggaggcggcattacccaaagccgcacagctggtaaatgggaaaagaggggtttaaaggtacgtgccctggaggaggccaatgctgacctggaggtgaagatccatgactggtaccagaagcagaccccaaccagcccagaatgcgactacagccaatacttcaagaccattgaagagctccgggacaaggttgctactggctggaatgttctgtagatccatggctgtgtccaaggtgtgcaggaggcagtgaccatgagttgtccacagtggggctggtggagtgtctctgagagagctattgtcagagctggctgcaccccactgccccactctcctgggcaaccaattcccacaggcaatactgcctccttggtctttcgtgccctggagataaggaaggcagctcctcaggtgtctcaaggaggctggatgggacaaaacaagaaatggacactgaaaatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagag

SEQ ID NO: 145397 - DNA, 1644 bp, Homo sapiens
  Payload ID: 8744
  Gene Symbol: KRT16
  Gene Name: keratin 16, type I
  Uniprot ID: P08779
  ENST ID: ENST00000301653
  CDS Start-End: 66-1487
gccttcctgagcacctttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaa

SEQ ID NO: 145398 - DNA, 499 bp, Homo sapiens
  Payload ID: 8744
  Gene Symbol: KRT16
  Gene Name: keratin 16, type I
  ENST ID: ENST00000590990
  CDS Start-End: 354-499
acttttccttcctcctgccctgaagcctgtggctctggcttgtccacccgaggctgggggccctgcagcagccccctctctcccctcagcttctctgcccccctccttagcccccaagctgcctcctgccttcccagtctgagttggctggggagcttgtaaaacagccccaccagcaggcttgtcctgagcggtgctgatgcgggagttggagcagggctgcaaatcttcatggggactctgacgatctgtctggttggagaatcactgcaagtcaaggcgtggcattggccaatggtgtttcccggctgcctcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcgg

SEQ ID NO: 145399 - DNA, 910 bp, Homo sapiens
  Payload ID: 8744
  Gene Symbol: KRT16
  Gene Name: keratin 16, type I
  ENST ID: ENST00000593067
  CDS Start-End: 423-910
gctgaataatccagagtgaggagttggacgggaccgggagtgatgaaatccagaggggaacctggagtcagcagttaggagggccccgccttccccagctgcatataaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtacca

SEQ ID NO: 145400 - DNA, 1524 bp, Homo sapiens
  Payload ID: 8745
  Gene Symbol: KRT17
  Gene Name: keratin 17, type I
  Uniprot ID: Q04695
  ENST ID: ENST00000311208
  CDS Start-End: 69-1367
ctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagctatgaaa

SEQ ID NO: 145401 - DNA, 1438 bp, Homo sapiens
  Payload ID: 8745
  Gene Symbol: KRT17
  Gene Name: keratin 17, type I
  ENST ID: ENST00000540235
  CDS Start-End: 238-1287
ctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagct

SEQ ID NO: 145402 - DNA, 566 bp, Homo sapiens
  Payload ID: 8745
  Gene Symbol: KRT17
  Gene Name: keratin 17, type I
  ENST ID: ENST00000590038
  CDS Start-End: 420-566
tcctttaaggccgagcctgccatgggggtctggtggggtactgagtatcgggggaagaagaggcacctttcagcccttcagactcctgtttgcccctcctctgccaataatacagcacggggcaagggaggggctgggcgagaagagaggccctgaggcaggaagatctgctcagaaccctggtgtgggctcagccacccccatccaatgacctgactactctcccttctcctcagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggagatgaacgccctgcgaggccaggtgggtggtgagatcaatgtggagatggacgctgccccaggcgtggacctgagccgcatcctcaacgag

SEQ ID NO: 145403 - DNA, 695 bp, Homo sapiens
  Payload ID: 8745
  Gene Symbol: KRT17
  Gene Name: keratin 17, type I
  ENST ID: ENST00000577817
  CDS Start-End: 1-695
ggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaaggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaa

SEQ ID NO: 145404 - DNA, 697 bp, Homo sapiens
  Payload ID: 8745
  Gene Symbol: KRT17
  Gene Name: keratin 17, type I
  ENST ID: ENST00000463128
  CDS Start-End: 413-697
gaaagcatagctggagggcccgcctgaatcacaggtgacgggcctgagaccagaggcacgcacacgcacggcactcagcacgaggatttggagaaatgaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatc

SEQ ID NO: 145405 - DNA, 1562 bp, Homo sapiens
  Payload ID: 8746
  Gene Symbol: KRT18
  Gene Name: keratin 18, type I
  Uniprot ID: P05783
  ENST ID: ENST00000388835
  CDS Start-End: 211-1503
cggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 145406 - DNA, 1420 bp, Homo sapiens
  Payload ID: 8746
  Gene Symbol: KRT18
  Gene Name: keratin 18, type I
  Uniprot ID: P05783
  ENST ID: ENST00000388837
  CDS Start-End: 70-1362
gcagcctcgagggccaacaacacctgctgtccgtgtccatgcccggttggccaccccgtttctgggggcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttc

SEQ ID NO: 145407 - DNA, 1696 bp, Homo sapiens
  Payload ID: 8746
  Gene Symbol: KRT18
  Gene Name: keratin 18, type I
  ENST ID: ENST00000550600
  CDS Start-End: 55-1230
aacaacacctgctgtccgtgtccatgcccggttggccaccccgtttctgggggcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaagtgagtggggctctcctacccacacgtgctgggatcaggagatcacttctccccaaagtctgagcttttggaagcaccccatgtgtctgttcactggtatccactgagcactgggccgttgctccgtgggtgctcctgtgtcttcaagggagtaacagttacagaggtctcccccttgaagaaagcaaactaagtattgtccctagctgtacttagtatgcaaatgaagtttggccttgagtttcccttttctggaggaagaggctgagggtgatttggagataaaggtagaggtcaggaggctttttccctctacctttcttgtctcccttctactccacggggctgtttataacttgggcttggtcttctgttacagtcttggtgatgccttggacagcagcaactccatgcaaaccatccaaaagaccaccacccgccggatagtggatggcaaagtggtgtctgag

SEQ ID NO: 145408 - DNA, 1390 bp, Homo sapiens
  Payload ID: 8747
  Gene Symbol: KRT19
  Gene Name: keratin 19, type I
  Uniprot ID: P08727
  ENST ID: ENST00000361566
  CDS Start-End: 62-1264
gctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 145409 - DNA, 641 bp, Homo sapiens
  Payload ID: 8747
  Gene Symbol: KRT19
  Gene Name: keratin 19, type I
  ENST ID: ENST00000455635
  CDS Start-End: 53-641
gcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggcc

SEQ ID NO: 145410 - DNA, 728 bp, Homo sapiens
  Payload ID: 8747
  Gene Symbol: KRT19
  Gene Name: keratin 19, type I
  ENST ID: ENST00000593096
  CDS Start-End: 186-728
ctgtttgcaaggcctcccagagagcgggccaatgggcggcagatgctggctagggctttggtctctagggtgccgggattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgag

SEQ ID NO: 145411 - DNA, 2403 bp, Homo sapiens
  Payload ID: 8748
  Gene Symbol: KRT2
  Gene Name: keratin 2, type II
  Uniprot ID: P35908
  ENST ID: ENST00000309680
  CDS Start-End: 23-1942
ttcctccctggacaaaggcatcatgagttgtcagatctcttgcaaatctcgaggaagaggaggaggtggaggaggattccggggcttcagcagcggctcagctgtggtgtctggtggaagccggagatcaacttccagcttctcctgcttgagccgccatggtggtggtggcgggggcttcggtggaggcggctttggcagtcggagtcttgttggccttggagggaccaagagcatctccattagtgtggctggaggaggtggtggctttggcgccgctggtggatttggtggcagaggaggtggttttggaggcggcagcagctttggaggtggcagcggcttcagtggtggtggtttcggtggaggcggctttggtggaggccgctttggaggttttgggggccctggtggtgttggaggtttagggggtcctggtggctttgggcctggaggataccctggtggcatccacgaagtctctgtcaaccagagcctcctgcagcctctcaacgtgaaagttgacccagagatccagaatgtgaaggcccaagagcgtgagcagatcaaaactctcaacaacaaatttgcctccttcattgacaaggtgcggttcttggagcagcagaaccaggtgttacagaccaaatgggagctgctacaacaaatgaatgttggcacccgccccatcaacctggagcccatcttccaggggtatatcgacagcctcaagagatatctggatgggctcactgcagaaagaacatcacagaattcagagctgaataacatgcaggatcttgtggaggattataagaagaagtatgaggatgaaatcaataagcgcacagctgctgagaatgattttgtgacgcttaaaaaggacgtggacaatgcctacatgataaaggtggagttgcagtccaaggtggacctgctgaaccaggaaattgagtttctgaaagttctctatgatgcggagatatcccagatacatcagagtgtcactgacaccaacgtcatcctctccatggacaacagccgcaacctggacttggatagcatcatcgccgaggtcaaggcccagtatgaggagatcgcccagaggagcaaggaagaagcggaggccctgtaccacagcaagtatgaggagctccaggtgactgtcgggagacatggagacagcctgaaagagatcaagatagagatcagcgagctgaaccgcgtgatccagaggctgcagggggagatcgcacatgtgaagaagcagtgtaagaatgtgcaagatgccatcgcagatgccgagcagcgtggggagcatgccctcaaggatgccaggaacaagttgaatgacctggaggaggccctgcagcaggccaaggaggacttggcgcggctgctgcgtgactaccaggagctgatgaacgtgaagctggccctagatgtggagatcgccacctaccgcaaactgctggagggcgaggagtgcaggatgtctggagacctcagcagcaatgtgactgtgtctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacacagctctggaggtggctctagaggaggctccagctctggaggaggatatggctctggaggtgggggttctagctctgtaaagggtagctcaggtgaagcttttggttccagcgtgaccttctcttttagataaagatgagcccccaccaccaccgactctcccaacccagactctcccactccagaatgtagaagcctgtctctgtacctctaactggcagcaagttaaatttttgtcatttatctctgatggcactttgagggaaaagaatgtccacatacagtttttgaaagatcttctctccaaaccagttagttagagccagtgacgcctctgtgttctggggcggaatctgtgctgtctaggtttgtgcttctagccatgcccattcccgcccccaccatgcctctttgcattgcccattttccagatgtgtattctgttgaggacccaggcccatccagggatttcatctctaagcctggcagtgctggggggaaatgtgtttctgtgtatatagctcctcttgtccactctgctttcggaagtgctgtggtctgggggtcttcataataaacctcatttgcaattca

SEQ ID NO: 145412 - DNA, 1737 bp, Homo sapiens
  Payload ID: 8749
  Gene Symbol: KRT20
  Gene Name: keratin 20, type I
  Uniprot ID: P35900
  ENST ID: ENST00000167588
  CDS Start-End: 43-1317
caaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggcatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaagtcagattaaggatgctcaactgcaaaatgctcggtgtgtcctgcaaattgataatgctaaactggctgctgaggacttcagactgaagtatgagactgagagaggaatacgtctaacagtggaagctgatctccaaggcctgaataaggtctttgatgacctaaccctacataaaacagatttggagattcaaattgaagaactgaataaagacctagctctcctcaaaaaggagcatcaggaggaagtcgatggcctacacaagcatctgggcaacactgtcaatgtggaggttgatgctgctccaggcctgaaccttggcgtcatcatgaatgaaatgaggcagaagtatgaagtcatggcccagaagaaccttcaagaggccaaagaacagtttgagagacagactgcagttctgcagcaacaggtcacagtgaatactgaagaattaaaaggaactgaggttcaactaacggagctgagacgcacctcccagagccttgagatagaactccagtcccatctcagcatgaaagagtctttggagcacactctagaggagaccaaggcccgttacagcagccagttagccaacctccagtcgctgttgagctctctggaggcccaactgatgcagattcggagtaacatggaacgccagaacaacgaataccatatccttcttgacataaagactcgacttgaacaggaaattgctacttaccgccgccttctggaaggagaagacgtaaaaactacagaatatcagttaagcaccctggaagagagagatataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggtggggtggcgggaatcctatttatcagactctgtaattgaatataaatgttttactcagaggagctgcaaattgcctgcaaaaatgaaatccagtgagcactagaatatttaaaacatcattactgccatctttatcatgaagcacatcaattacaagctgtagaccacctaatatcaatttgtaggtaatgttcctgaaaattgcaatacatttcaattatactaaacctcacaaagtagaggaatccatgtaaattgcaaataaaccactttctaattttttcctgtttctgaa

SEQ ID NO: 145413 - DNA, 1737 bp, Homo sapiens; identical to SEQ ID NO: 145412
  Payload ID: 8749
  Gene Symbol: KRT20
  Gene Name: keratin 20, type I
  Uniprot ID: P35900
  ENST ID: ENST00000576098
  CDS Start-End: 43-1317

SEQ ID NO: 145414 - DNA, 2764 bp, Homo sapiens
  Payload ID: 8750
  Gene Symbol: KRT222
  Gene Name: keratin 222, type II
  ENST ID: ENST00000394049
  CDS Start-End: 58-234
gcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagtacagtctctttctttatattctcccaatagtcttctttttcccttgaaacttcatcagagactgtaagcattaacctggtttagtaaagtctttgtaatttttttcaatggctgaatacgctaaggaaaaaagaattgtttgaataggattgtgttaagagtcacactgagttattcaccattattccatgactggttaaacctacaatgtttgttctatttttcaaaaagagcaattataaacaagtttttaaagggggactcactattcacctaatgaggattcttctttttgagataaatcatttgtatactgagaaaaatgagttattttccatgagaaattctgagcaaactatagaacacaccccagggctaatttgagataagtacaattaagttaatctacatatatctaaaaggttttttttgtaataagtatctgatttccggaagatttactttactcaaggaactttaaaggttgtatcccccaccaaaaaaagaaaaaaaatcagaaggccaactgcgcaaacaaaacatgaaaagcaaattgaaaaggtagttactatagttatcagaacagttacccaccatcccagtttttccaactgtaaagctaaatgtgattagattgtttgctataagccgtagataagatactatatgaagtattataaatatttcttgcaatcatttatgtgaactaagataacggtattgttatctaagctaagagtatttagaggatttgtttttaaatcgttcaaattgtaataaatatgggtagaaaatatatttgtgaataagtgaggtattgttgcaaagtttttaaaataacctaatttgtttaatacaggtatatttaagatcttaataaatacctgttttaagacattagaaatttataagttcttaattcttttctaagcagaaaaagtagctgagtacaactcaccatactttttcccagctaaagtatcatctaagggctatagctacgttagcattttagtacagcctttaaaatatttctctctctctctcctctctcttctcctctatctctctctccatatatacttattatatatatacatatatataatttatatatatgtatatatatatttcaaccagaaaaatgtatgttttaaccaggaaaatattatgttaaataatctttaacataatacagggatataaaatttttaattttctttcaattacttcagattccttttagtctggtttattctatttagtgaaaagggatgattttgttttgtcaaggatataacagcatgttaagtgcttattcttgcataagcatctgacctaaaatacatcctatacataaaaaatgtttcatttgatattgctaaatgctactaactttattaaagctttaaaaatgcaatcatataagctattgtactaaagttactgtactaagcaacagtgatcataataaagcaatatatctagcataa

SEQ ID NO: 145415 - DNA, 1712 bp, Homo sapiens
  Payload ID: 8750
  Gene Symbol: KRT222
  Gene Name: keratin 222, type II
  Uniprot ID: Q8N1A0
  ENST ID: ENST00000394052
  CDS Start-End: 43-930
atcgataaggttcagttagccaaggtggaggatgggaaaagaatggaactgtcccagctactcaatgagatcagggcaaactatgaaaagatcctcaccagaaatcagatagagacggtgctctcaacaaggatccagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagtacagtctctttctttatattctcccaatagtcttctttttcccttgaaacttcatcagagactgtaagcattaacctggtttagtaaagtctttgtaatttttttcaatggctgaatacgctaaggaaaaaagaattgtttgaataggattgtgttaagagtcacactgagttattcaccattattccatgactggttaaacctacaatgtttgttctatttttcaaaaagagcaattataaacaagtttttaaagggggactcactattcacctaatgaggattcttctttttgagataaatcatttgtatactgagaaaaatgagttattttccatgagaaattctgagcaaactatagaacacaccccagggctaatttgagataagtacaattaagttaatctacatatatctaaaaggttttttttgtaataagtatctgatttccggaagatttactttactcaaggaactttaaaggttgtatcccccaccaaaaaaagaaaaaaaatcagaaggccaactgcgcaaacaa

SEQ ID NO: 145416 - DNA, 1116 bp, Homo sapiens
  Payload ID: 8750
  Gene Symbol: KRT222
  Gene Name: keratin 222, type II
  ENST ID: ENST00000581564
  CDS Start-End: 47-223
tcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcaggtgagtttctgacataaataaactcatttgaaaagtgatgtactatttacagggattactttataaggaaattaaatactttaaagtcgaaaaaaaacaagcaatatttgaataaaagtttgaatataatttgtgaacagtaattcaatactgtaatttaatatatcataaatgatattttcacagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagtaagtaaagaaactttgactaagaaataataataaatatatgtaaagaaattaactttgcgtaatcccagtaattactcttctttgtttaaatgtttccaaacatagttttagtatactgtgatttttttttttttttttga

SEQ ID NO: 145417 - DNA, 490 bp, Homo sapiens
  Payload ID: 8750
  Gene Symbol: KRT222
  Gene Name: keratin 222, type II
  ENST ID: ENST00000580719
  CDS Start-End: 83-259
ttccgcgcagaccgagcagactgccgcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagaagcactccttgttttttgtttgttattgttgctgttggctttcttgttagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagat

SEQ ID NO: 145418 - DNA, 1987 bp, Homo sapiens
  Payload ID: 8751
  Gene Symbol: KRT23
  Gene Name: keratin 23, type I
  Uniprot ID: Q9C075
  ENST ID: ENST00000209718
  CDS Start-End: 426-1694
gggaaatcctgagcgcaggccagggttgtttggttttgaggtgtgctgggatgaaaggcaccctggaagtggaaggtaaatgaacaatggaaaaacttcacggcaagattagaaagatacctgagcccaatacccgcctgatgtcgtgggccacacctccgggttaccaggggaagggaggaagcaaactgtcatattgatgtggctctaaacaacaacagtgtgcgaaggcccaggggcactttgggattgaccaagaggaaacacaagttgcacaatgatacaatcttgttggtacaattgtcagagaagggaactcccacagcaaaggccataaaaccatccagggcagtctggggcggctcagttctgcggtgccagggagtggagcagagctcagccccgtcccaaacacagatgggaccatgaactccggacacagcttcagccagaccccctcggcctccttccatggcgccggaggtggctggggccggcccaggagcttccccagggctcccaccgtccatggcggtgcggggggagcccgcatctccctgtccttcaccacgcggagctgcccaccccctggagggtcttggggttctggaagaagcagccccctactaggcggaaatgggaaggccaccatgcagaatctcaacgaccgcctggcctcctacctggagaaggttcgcgccctggaggaggccaacatgaagctggaaagccgcatcctgaaatggcaccagcagagagatcctggcagtaagaaagattattcccagtatgaggaaaacatcacacacctgcaggagcagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaaggaccttagacaacctgaccattgtcacaacagacctagaacaggaggtggaaggaatgaggaaagagctcattctcatgaagaagcaccatgagcaggaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcagacacagtacagcacgaaatctgctttggaaaacatgttatccgagacccagtctcggtactcctgcaagctccaggacatgcaagagatcatctcccactatgaggaggaactgacgcagctacgccatgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagctgca

SEQ ID NO: 145419 - DNA, 1485 bp, Homo sapiens
  Payload ID: 8751
  Gene Symbol: KRT23
  Gene Name: keratin 23, type I
  Uniprot ID: Q9C075
  ENST ID: ENST00000436344
  CDS Start-End: 339-1196
acaacggctacattcctcccccagggccaagggaaatcctgagcgcaggccagggttgtttggttttgaggtgtgctgggatgaaaggcaccctggaagtggaaggttcggtcattcattaattaattacatctataattgagggtttgttcttaagagcgagtcctttgaaagtactttccttcaaacagtgactgccacaaaggcatcagatattcaccaccttctcggctgcctcagcacagcaagctttattctgggacctgagatcctgttctgagctggctttcccttctccaggctcgctcaccctccctttagagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaaggaccttagacaacctgaccattgtcacaacagacctagaacaggaggtggaaggaatgaggaaagagctcattctcatgaagaagcaccatgagcaggaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcagacacagtacagcacgaaatctgctttggaaaacatgttatccgagacccagtctcggtactcctgcaagctccaggacatgcaagagatcatctcccactatgaggaggaactgacgcagctacgccatgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagc

SEQ ID NO: 145420 - DNA, 1987 bp, Homo sapiens; identical to SEQ ID NO: 145418
  Payload ID: 8751
  Gene Symbol: KRT23
  Gene Name: keratin 23, type I
  Uniprot ID: Q9C075
  ENST ID: ENST00000574480
  CDS Start-End: 426-1694

SEQ ID NO: 145421 - DNA, 1485 bp, Homo sapiens; identical to SEQ ID NO: 145419
  Payload ID: 8751
  Gene Symbol: KRT23
  Gene Name: keratin 23, type I
  Uniprot ID: Q9C075
  ENST ID: ENST00000571258
  CDS Start-End: 339-1196

SEQ ID NO: 145422 - DNA, 1462 bp, Homo sapiens
  Payload ID: 8751
  Gene Symbol: KRT23
  Gene Name: keratin 23, type I
  ENST ID: ENST00000462312
  CDS Start-End: 473-586
ggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaaggttcggtcattcattaattaattacatctataattgagggtttgttcttaagagcgagtcctttgaaagtactttccttcaaacagtgactgccacaaaggcatcagatattcaccaccttctcggctgcctcagcacagcaagctttattctgggacctgagatcctgttctgagctggctttcccttctccaggctcgctcaccctccctttagagatagtggatggtaagatgaccaatgctcagattattcttctcattgacaatgccaggatggcagtggatgacttcaacctcaagaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcagacacagtacagcacgaaatctgctttggaaaacatgttatccgagacccagtctcggtactcctgcaagctccaggacatgcaagagatcatctcccactatgaggaggaactgacgcagctacgccatgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagc

SEQ ID NO: 145423 - DNA, 687 bp, Homo sapiens
  Payload ID: 8751
  Gene Symbol: KRT23
  Gene Name: keratin 23, type I
  ENST ID: ENST00000581268
  CDS Start-End: 1-450
gggaaggccaccatgcagaatctcaacgaccgcctggcctcctacctggagaaggttcgcgccctggaggaggccaacatgaagctggaaagccgcatcctgaaatggcaccagcagagagatcctggcagtaagaaagattattcccagtatgaggaaaacatcacacacctgcaggagcagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaaggaccttagacaacctgaccattgtcacaacagacctagaacaggaggtggaaggaatgaggaaagagctcattctcatgaagaagcaccatgagcaggtacaactccccaggaacacctgctaataagcacagctcttagcctgcacatctcaggctgattcgacagctacagaagaaaccaccacctggatgccaatccccttgtccttcaccctaaatagtctttagaaaaacatacaaatatctaatgtttctaatttcaaggttagctagtcacatgtcaaatacaacaaccaaaatgcaatcataattaatgatgaattggtcaacagttttgttaatacacaatgtttacctaga

SEQ ID NO: 145424 - DNA, 700 bp, Homo sapiens
  Payload ID: 8751
  Gene Symbol: KRT23
  Gene Name: keratin 23, type I
  ENST ID: ENST00000574395
  CDS Start-End: 348-461
cccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaagtgactgccacaaaggcatcagatattcaccaccttctcggctgcctcagcacagcaagctttattctgggacctgagatcctgttctgagctggctttcccttctccaggctcgctcaccctccctttagagatagtggatggtaagatgaccaatgctcagattattcttctcattgacaatgccaggatggcagtggatgacttcaacctcaagaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcagacacagtacagcacg

SEQ ID NO: 145425 - DNA, 1462 bp, Homo sapiens; identical to SEQ ID NO: 145422
  Payload ID: 8751
  Gene Symbol: KRT23
  Gene Name: keratin 23, type I
  ENST ID: ENST00000571504
  CDS Start-End: 473-586

SEQ ID NO: 145426 - DNA, 687 bp, Homo sapiens; identical to SEQ ID NO: 145423
  Payload ID: 8751
  Gene Symbol: KRT23
  Gene Name: keratin 23, type I
  ENST ID: ENST00000584517
  CDS Start-End: 1-450

SEQ ID NO: 145427 - DNA, 700 bp, Homo sapiens; identical to SEQ ID NO: 145424
  Payload ID: 8751
  Gene Symbol: KRT23
  Gene Name: keratin 23, type I
  ENST ID: ENST00000494691
  CDS Start-End: 348-461

SEQ ID NO: 145428 - DNA, 865 bp, Homo sapiens
  Payload ID: 8751
  Gene Symbol: KRT23
  Gene Name: keratin 23, type I
  ENST ID: ENST00000485751
  CDS Start-End: 710-865
agccgtggcaggctcagccggggtccggggctgctaacaacggctacattcctcccccagggccaagggaaatcctgagcgcaggccagggttgtttggttttgaggtgtgctgggatgaaaggcaccctggaagtggaaggttcggtcattcattaattaattacatctataattgagggtttgttcttaagagcgagtcctttgaaagtactttccttcaaacagtgactgccacaaaggcatcagatattcaccaccttctcggctgcctcagcacagcaagctttattctgggacctgagatcctgttctgagctggctttcccttctccaggctcgctcaccctccctttagaggtaaatgaacaatggaaaaacttcacggcaagattagaaagatacctgagcccaatacccgcctgatgtcgtgggccacacctccgggttaccaggggaagggaggaagcaaactgtcatattgatgtggctctaaacaacaacagtgtgcgaaggcccaggggcactttgggattgaccaagaggaaacacaagttgcacaatgatacaatcttgttggtacaattgtcagagaagggaactcccacagcaaaggccataaaaccatccagggcagtctggggcggctcagttctgcggtgccagggagtggagcagagctcagccccgtcccaaacacagatgggaccatgaactccggacacagcttcagccagaccccctcggcctccttccatggcgccggaggtggctggggccggcccaggagcttccccagggctcccaccgtccatggcggtgcggggggagcccgcatctccctgtccttcaccacgcggagctgc

SEQ ID NO: 145429 - DNA, 865 bp, Homo sapiens; identical to SEQ ID NO: 145428
  Payload ID: 8751
  Gene Symbol: KRT23
  Gene Name: keratin 23, type I
  ENST ID: ENST00000572233
  CDS Start-End: 710-865

SEQ ID NO: 145430 - DNA, 1881 bp, Homo sapiens
  Payload ID: 8752
  Gene Symbol: KRT24
  Gene Name: keratin 24, type I
  Uniprot ID: Q2M2I5
  ENST ID: ENST00000264651
  CDS Start-End: 58-1635
actcttcgtcatcacctctcctattcgcctggacaagctcatgtttgcaggagcaccatgtcttgctcgtctcgcgcctcctcctccagggctggaggcagcagctcagccagggtgtctgctggtggaagcagcttcagcagtggaagcagatgtggtctggggggcagctcggcccagggcttccgaggaggagccagcagctgcagcctgagtggggggtctagcggtgcttttgggggcagctttggagggggctttggtagctgctcagtagggggtggttttgggggagcttcaggctctgggacaggatttggtgggggttctagctttggcggggtctctggatttggcaggggttctggattctgtgggagttctagattcagcagtggtgctactggaggcttctacagctatggtggtggtatgggaggtggtgttggcgatggggggcttttctctggaggggaaaagcaaaccatgcagaacctcaatgaccgcttggccaattacctagacaaggtcagagccctggaggaggctaacactgatctggagaacaaaatcaaggagtggtatgacaaatatgggcctgggtctggagacggtggatcgggaagagattatagcaaatactattcaataattgaagatctcagaaaccagatcattgctgccactgttgaaaatgctgggatcattttgcacattgacaatgccagattggctgctgatgacttcagactgaagtatgagaacgagctgtgtctccggcagagcgtggaggctgacatcaatggcctgcggaaagtcctggatgacctgactatgacccgctctgacctggagatgcagattgagagtttcaccgaggagctagcctacctgaggaagaaccacgaggaggaaatgaagaatatgcaaggaagctctggaggggaggtgaccgtagaaatgaatgctgcgccagggaccgacctgaccaaattactgaatgacatgagggcgcagtacgaggagctggctgagcaaaaccgccgagaggctgaggagcggttcaacaagcagagcgcatcactacaagcacaaatctccactgatgctggggcagccacttctgccaagaatgagataacagaactaaaacgtaccctgcaagccctggaaattgagcttcagtcccaactggccatgaaaagctccctggagggaaccctggctgacacagaagctggctacgtggctcagctgtcagaaattcaaacgcagatcagtgccctggaggaggagatctgccagatctggggtgagactaaatgccagaacgcagagtacaagcaattgctggacatcaagacacgcctggaggtggagatcgagacctaccgccgcctgctcgatggagagggaggtggttctagttttgcagaatttggtggtagaaactcaggatctgtaaacatgggatccagggatctggtatctggtgactcaagatctggaagctgttctggtcaaggacgagattcaagcaagactagagtgactaagactatcgtagaggagttggtggatggcaaggttgtctcgtctcaagtcagcagtatttctgaggtgaaagttaaataaggaacttccagatcaacaaaagtgtctttcaaagaaaaaaaaatcaagaaggacacaagcgaagaaatggcatcaatctaggcatctttctggataatttcaggaaaagcttcagtccagaaatggatgactagccaacttttctgcatcttcttatttcctcattagaatgctcttgaaatagctgaattaacaactttgctttaattgtttctatgcttcaataaatttacttttgcaagttaa

SEQ ID NO: 145431 - DNA, 1670 bp, Homo sapiens
  Payload ID: 8753
  Gene Symbol: KRT25
  Gene Name: keratin 25, type I
  Uniprot ID: Q7Z3Z0
  ENST ID: ENST00000312150
  CDS Start-End: 62-1414
aagaaggcactccattctggctttcacaaatacagctctgcaacgcgtttgccctgataccatgtctcttcgactttccagtgcatccaggaggtcctgtcctcgtcccaccactggatcactcagactctatggtgggggaaccagctttggtactggaaattcttgtggcatttcagggattggaagtggcttctctagtgccttcggaggcagctcatcgggaggaaacacagggggaggtaatccctgtgctggcttcactgtgaatgagcgggggctcctttctggcaatgagaaggtgaccatgcagaacctcaatgaccgcctggcatcctacctggacagtgtgcatgctctggaggaggccaacgctgacctggagcagaagatcaagggctggtatgagaaatttgggcctggctcttgccgtggtcttgatcatgactatagcagatatttcccaataattgatgaccttaaaaatcagatcatcgcatccaccaccagcaatgctaatgctgttctgcagatcgataatgccaggcttacagctgatgatttcagactcaagtatgaaaatgagctggctcttcaccagagtgtagaggctgatgtcaatgggttacgaagagttttggatgaaataaccctgtgcagaacagatctggagattcagtatgaaaccctgagtgaggagatgacttacctcaaaaagaaccataaagaggaaatgcaagttctgcagtgcgcagctggaggcaacgtgaacgtggagatgaacgcagcccccggggtggacctcacagttctgctgaacaacatgcgagctgagtacgaagcccttgcagagcagaaccgcagggacgcggaggcctggttcaacgagaagagcgcctccctgcagcagcagatctctgaggatgtcggagccacaacctcagcccggaatgagctgactgaaatgaagcgcactcttcaaaccctggaaattgaacttcagtctctcctagccacgaaacactccctggagtgctccttgacagagaccgagagcaactactgtgcgcagctggcgcagatccaggctcagatcggggccctggaggagcagctgcaccaggtcagaaccgagaccgagggccagaagctggagtatgagcagctcctggacatcaagctccacctggaaaaagaaattgagacctactgtctccttataggaggagatgatggagcctgtaagtctgggggttacaagtctaaagattatggatctggaaatgtgggaagtcaagtcaaagacccagccaaagccatagtggttaagaaagttcttgaggaggtagaccaacgcagcaaaatacttaccaccaggctccactccctggaagagaaatctcaaagcaattaatttgagatgcaacagagaacgtatgccacatagcccctgcgaagaaaaggcattatgtatctgtccagaaaaatgtgcatgtctaagaaaaatgtctaacctgttgtctttctgttactttctttctgggcaatcaatgacagcatctccccattcatctagaagaatgccacacacaaatatgactcatttgattatcctacagaaatctgttgtcaattctttgtattcaataaacctcttctttagcaagtta

SEQ ID NO: 145432 - DNA, 1733 bp, Homo sapiens
  Payload ID: 8754
  Gene Symbol: KRT26
  Gene Name: keratin 26, type I
  Uniprot ID: Q7Z3Y9
  ENST ID: ENST00000335552
  CDS Start-End: 50-1456
tggctttgctcctctttctgggaaggggttgcccggctgtgctgccaccatgtcttttcgactttctggtggatccaggaggatctgctcgcgaactgggtctggtaggctgtccggtggaggaacaggcttcgtggctgggaatgtgtgtgttggatcgggagcaagaagcagcttttcttgtactcttgagggcatctcttctggaggaagcttctgcaatagcggtggagggttgggaagtggtgcctgtgctggttttcttggcaatgagcacagcctcctctctgggaatgaaaaggtgaccatgcagaatctcaacgaccgcctggcatcctacctggaccatgtgcatgctctagaggaggccaacgcagacctggagcagaagatcaagggctggtacgagaaatgtgagcctggctcttcccgggaacacgatcatgactatagcagatacttctcagtcatagaagatcttaaaaggcagattatttctgcgaccatctgcaatgccagcattgttctacaaaatgacaatgccagactgaccgctgatgacttcaggctgaagtatgaaaatgagctggctctgcaccacagtgttgaggccgacaccagtggtcttcgcagagtgttggatgaactgaccctttgtacaaccgacctggagatacagtgtgagaccctcagtgaggaattgacctacctcaaaaaaagtcatgaggaggaaatggaagtcttgcaatatacagctggggggaacgtgaacgtggagatgaatgcaaccccaggagtggacctaactgtcctgttgaacaacatgagggctgagtatgaggacttggctgagcagaaccgcaaagatgctgaagcctggttcaacgagaggagtgcaacgctgcaacaacagatttccgatcatgagggagcagccacagcagccagaaatgagctgaccgaattaaaacgcaatctgcaaaccctggaaatagaacttcagtccctcatggctgtgaaacattcctatgaatgctccttggctgagactgaaggaaattactgcaatcaactccagcaaattcaggatcagataggggtgatggaggaacaactgcaacagattcgaacagaaacagaaggccagaagctggagtatgaacagcttcttgatgtaaaaatatttttagaaaaagaaattgacatttattgcaacttactagatggagaagaaagaaaaagcaaatccacatgttacaaatcaaaaggatacaggcctgtgaattctggaaatcaagccaaagactcaacagaagaaactattgttaaaacagtggttgaggaactggatcaaattggcaatctcctttcactgagagtccactcagttgaagaaaagtcctctaaaataagcaacattacagtagagcaacgagtaccttctaaagcaccataatgaggaaaaagttatttggaaagaaagaaagaaagagagagagagagaaagaaagaaagaaaggctgcctttgcaaaaatcctactggtcaaataacctaaggaaattattcatttctgttcttaaaagggctagaatttgttctccttctcttccttttctcatgttctatgcatgtaatccttttccagagtagaaaaatcctgctctgtccctaatttttgtttttattttgggggccttttttgacatttcattaaaaattcttctattgcaa

SEQ ID NO: 145433 - DNA, 1612 bp, Homo sapiens
  Payload ID: 8755
  Gene Symbol: KRT27
  Gene Name: keratin 27, type I
  Uniprot ID: Q7Z3Y8
  ENST ID: ENST00000301656
  CDS Start-End: 42-1421
gagcatcaccgcagaaacaaaggctccagcctccggacaccatgtctgtgcgcttttcttctacctccaggagacttggctcttgcgggggcactggctctgtgaggctctctagtgggggagcaggctttggggctggaaacacatgcggtgtgccaggcattggaagtggcttctcttgtgcttttgggggcagctcatctgcaggaggctatggcggaggtctgggcgggggaagtgcttcctgtgctgccttcacagggaatgagcacggcctcctctctggcaatgagaaggtgaccatgcagaacctcaacgaccgcttggcctcctacctggagaatgttcgagccctagaggaggccaacgctgacttggagcagaagatcaaggggtggtatgagaaatttggacctggttcttgccgtggccttgatcatgattacagcagatatttcccaattattgacgaacttaagaaccagataatttctgcaactaccagtaatgcccatgttgtcctgcaaaatgataatgcaagactaacagctgatgacttcagactaaagtttgaaaacgagctagcgcttcaccagagcgtggaggcggacatcaatggtttgcgaagagtcctggatgagctgaccttgtgcagaacggacctggagatccagctggaaactctcagtgaggagctcgcttacctcaagaagaatcatgaggaggaaatgaaagctcttcagtgcgcggctggaggcaacgtgaacgtggagatgaacgcggcccccggggtagacctcacggttctgctgaacaatatgcgagctgagtacgaagccctcgcagagcagaaccgcagggacgcggaggcctggttcaacgaaaagagcgcctcgctgcagcagcagatctctgacgacgctggcgccaccacctcagcccggaatgagcttatcgagatgaaacgcactcttcaaacccttgagattgaacttcagtccctcttagcaacgaaacactccctggagtgctccttgacagagaccgagagtaactactgtgcacagctggcacagatccaggctcagatcggggccctggaggagcagctgcaccaggtcagaaccgagaccgagggccagaagctcgagtatgagcagctccttgacatcaaggtccacctggaaaaagaaattgagacctactgcctcctgatagatggagaagatggctcctgttctaaatcaaaaggctatggaggcccaggaaatcaaacaaaagattcatctaaaaccaccattgtcaaaacagttgttgaagagatagatcctcgtggcaaagttctctcatccagagttcacactgtggaagagaaatccaccaaagtcaacaacaagaatgaacagagggtgtcttcctgaactccagcctctgagacagaatggcccccaaattaaaataccaaaatgaagctagtttcctaaataagggtccccttatttttctgcttttcttccaatgaattaagacaagttatttttagaatagtaccatttctttggctttttctctatggtggtgtttcaataaaagttcttcctgttgcaagtca

SEQ ID NO: 145434 - DNA, 1685 bp, Homo sapiens
  Payload ID: 8756
  Gene Symbol: KRT28
  Gene Name: keratin 28, type I
  Uniprot ID: Q7Z3Y7
  ENST ID: ENST00000306658
  CDS Start-End: 67-1461
atgatattctgttctcttgggacattacagttttgcatagacaaggtgaacatttctcaaaacaccatgtctctccaattttctaatggatccaggcatgtttgcttaaggtctggagctggatctgtcagacccctcaatggaggtgcaggctttgcaggcagcagtgcatgtggtggctctgttgctggaagtgaattttcctgtgccttgggagggggcttgggcagtgttcctggtgggagccatgctggtggtgcccttggaaatgctgcttgtattggctttgctggaagcgaagggggactcctctctggaaatgagaaggtgaccatgcaaaatcttaatgaccgcttggcatcctacctggataatgtgcgagctctggaggaggcaaatgctgaattagagagaaaaatcaagggttggtatgaaaaatacggacctggatcttgccgtggacttgatcatgactatagcagatatcacctaacaattgaggatcttaagaataagattatctcctccactactactaatgctaatgtcattctgcagattgataatgccagactggctgctgatgatttcaggctaaagtatgaaaatgagctcacccttcaccaaaacgtagaggccgacatcaacggattacggcgagtcctggacgagctgacgctctgcaggaccgaccaggagctgcaatatgagtctctgagtgaggagatgacatatctcaaaaagaaccacgaagaggagatgaaggctctgcagtgcgcggctgggggcaacgtgaacgtggagatgaacgcggccccgggggtagacctcgcggttttgttgaacaacatgcgagcggagtacgaagcccttgcagagcagaaccgcaaggacgcggaggcctggttcaatgagaagagcgcctcgctgcagcaacagatctcccacgactcaggcgcagccactttcgcccggagccagctcaccgagatgaggcgcaccctgcagaccctggagatccagctgcagtccctgatggccacgaaacactccctggagtgctccttgacagagaccgagagcaactactgtacgcagctggcgcagatccaggctcagatcggggccctggaggagcagctgcaccaggtcagaaccgagaccgagggccagaagctggagtatgagcatctcctcgatgtcaaggtccacttggaaaaagaaattgagacctactgccgcctgatagatggagatggaaattcatgctccaaatcaaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtg

SEQ ID NO: 145435 - DNA, 2319 bp, Homo sapiens
  Payload ID: 8757
  Gene Symbol: KRT3
  Gene Name: keratin 3, type II
  Uniprot ID: P12035
  ENST ID: ENST00000417996
  CDS Start-End: 76-1962
atttcccatccctcttcctctgactctcagtgtccctgcttaacttacactcttctcttcgccaagctccttaccatgagcagacaagccagcaagacatctggtggcgggagccagggtttctccggccgctctgctgtggtctccggcagcagcaggatgagctgtgtggcccactctgggggagctggcggaggggcctatggcttccggagcggagcaggtggctttggcagtcgcagcctctacaacctgggcggcaacaagagcatctccatcagcgtggcagctggcggctcccgggctggaggctttgggggagggcggagcagctgtgcctttgcaggtggctatggaggtggctttgggagcggctatggaggtggctttggtggtggctttggtggtggcagaggaatgggaggtggctttggtggagctggtggctttggaggggctggtggctttggaggggctggtggctttggtggtcctggtggctttggtgggtctggtggctttggtgggcctggcagcttgggcagtcctggtggctttggccctgggggctttcctgggggaattcaggaagtgactatcaaccagagtctcctgcagcccctcaatgtggagatcgacccccagattgggcaagtaaaggcccaggagcgggaacagatcaagaccctcaacaacaagtttgcctccttcattgacaaggtgcggttcctggagcaacagaacaaagtcctggagaccaagtggaacctgctccagcagcagggcacaagttccatctcaggcacaaacaaccttgagcctctttttgagaatcacatcaactacctgcggagctacctggacaacatcctcggggagagagggcgcctggactctgagctgaagaacatggaggacctggtggaagacttcaagaagaaatatgaggatgaaatcaataaacgtacagctgctgagaatgaatttgtgactctgaagaaggatgtggacagtgcctatatgaacaaggtggagcttcaggccaaagtggatgccttgatagatgagatcgacttcttaaggaccctctacgacgctgagctatctcagatgcagagccacatcagtgacacatctgtggtgctgtccatggacaataatcgctccctggacctggacagcatcattgctgaagttcgtgcacagtatgaggatatcgctcagagaagcaaggccgaagctgaggccctgtaccagaccaagttgggggagctgcagaccacggctggcaggcatggggatgacctaagaaataccaagagcgagatcatagagctcaacagaatgatccagaggctgcgggcagagatcgagggtgtcaagaagcagaatgccaacctgcagacggccattgccgaggccgagcagcatggagagatggccctcaaggatgccaatgccaagctccaagagctgcaggctgctctacagcaggcgaaggatgacctggcgcggctgctacgtgactaccaggagctgatgaatgtcaagctggccctggacgtggagatcgccacctaccgcaagctgctggagggcgaggagtacaggatgtctggagagtgtccgagtgctgtcagcatctccgtggtcagcagcagcacgacttccgcctccgcaggtggctatggaggaggttacggcggaggcatgggcggtggtttaggaggtggcttcagtgcgggcggcggctcaggcagtggctttggccggggaggcggcggtggaatcggcggtggatttggcggcggcagcagcggtttcagcggtggcagcggctttggctccatctctggcgcccgctatggagtcagtggcgggggcttcagctcggccagcaaccggggcggcagcatcaagttctcccagtcctcccagtcctcccagcgctactccagataaagagcacgcatcagcatcgcagccactccagcgcctcccctccgctccccacgcccccatattggcaacacccccagcgccaccccatgctccccaagaacgcggctctgcgctggaaggcttgtggcctcttgctcctccttccagatccccggccaagcccagtcacgagaatttcaggctcttctctccggctccagcctgtgcctgtgattgtccaggtgtggcctaggccgccaccttctgctgccccggagtcccctccctgggtgggatgctcactacagctctgatgtatatagcacacagccccctccgcccctccggtctgtcgccaataaagtgcactgtgtttca

SEQ ID NO: 145436 - DNA, 1596 bp, Homo sapiens
  Payload ID: 8758
  Gene Symbol: KRT31
  Gene Name: keratin 31, type I
  Uniprot ID: Q15323
  ENST ID: ENST00000251645
  CDS Start-End: 54-1304
gagaatttagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgtgagcaactgcaactggttctgcgagggctccttcaatggtagcgagaaggagactatgcagttcctgaacgaccgcctggccagctacctggagaaagtgcgtcagctggagcgggacaacgcggagctggagaacctcatccgggagcggtctcagcagcaggagcccttgctgtgccccagttaccagtcctattttaagaccattgaggagctccagcagaagatcctgtgtaccaagtctgagaatgccaggcttgtggtgcagatcgacaacgccaagctggctgcggatgatttcagaaccaagtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcagaccgaggagctgaacaagcaggtggtatccagctcagagcagctgcagtcctaccaggcggagatcatcgagctgagacgcacagtcaacgccctggagatcgagctgcaggcccagcacaacctgcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaatctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtgggcctcccttttaacctcctaataaatatcatttccttggcaaa

SEQ ID NO: 145437 - DNA, 1596 bp, Homo sapiens
  Payload ID: 8758
  Gene Symbol: KRT31
  Gene Name: keratin 31, type I
  Uniprot ID: Q15323
  ENST ID: ENST00000573281
  CDS Start-End: 54-1304
gagaatttagactctgtcttcagccaggcactcactccctccctcccagcactatgccctacaacttctgcctgcccagcctgagctgccgcaccagctgctcctcccggccctgcgtgccccccagctgccacagctgcaccctgcccggggcctgcaacatccccgccaatgtgagcaactgcaactggttctgcgagggctccttcaatggtagcgagaaggagactatgcagttcctgaacgaccgcctggccagctacctggagaaagtgcgtcagctggagcgggacaacgcggagctggagaacctcatccgggagcggtctcagcagcaggagcccttgctgtgccccagttaccagtcctattttaagaccattgaggagctccagcagaagatcctgtgtaccaagtctgagaatgccaggcttgtggtgcagatcgacaacgccaagctggctgcggatgatttcagaaccaagtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcagaccgaggagctgaacaagcaggtggtatccagctcagagcagctgcagtcctaccaggcggagatcatcgagctgagacgcacagtcaacgccctggagatcgagctgcaggcccagcacaacctgcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaatctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtggccctcccttttaacctcctaataaatatcatttccttggcaaa

SEQ ID NO: 145438 - DNA, 1750 bp, Homo sapiens
  Payload ID: 8759
  Gene Symbol: KRT32
  Gene Name: keratin 32, type I
  Uniprot ID: Q14532
  ENST ID: ENST00000225899
  CDS Start-End: 105-1451
ttctatcatgagccccctcactgcaagggcataaaatggcccgggcggcatggggtctgtagacatccaggtagctgtggctgaggagaaagggcctctccaacatgacatcctcctgctgtgtcaccaacaacttgcaagcctctctcaagagctgcccccggcctgcctcggtctgttccagcggcgtgaactgccggcctgagctgtgcctgggctatgtctgccagcccatggcatgcctgccttcggtctgcctgcccaccaccttccggccagccagctgcctctccaaaacctatctatccagttcctgccaggcagccagtggcatctccggctccatgggccccggcagctggtacagcgaaggggccttcaatggcaatgagaaggaaaccatgcagttccttaacgaccgcctggccagctacctgacgagggtgcggcagctggagcaggagaatgcggagctggagagcaggatccaagaggcctctcactcccaggtgctcaccatgactcctgactaccagtctcatttcaggaccattgaggagctccagcagaagattctgtgtaccaaggcagagaatgccaggatggttgtgaacattgataatgccaaactggctgccgatgacttcagggccaagtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagaacgaggactgcaagctgccctgtaacccatgctccactccttcctgcaccacctgtgtgccctccccatgcgtgccccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaa

SEQ ID NO: 145439 - DNA, 1287 bp, Homo sapiens
  Payload ID: 8760
  Gene Symbol: KRT33A
  Gene Name: keratin 33A, type I
  Uniprot ID: O76009
  ENST ID: ENST00000007735
  CDS Start-End: 46-1260
gagattttggactctgtcttcagctggacactccctccctgcaccatgtcttacagttgtggcctgcccagcctgagctgccgcaccagctgctcctcccggccctgtgtgccccccagctgccacggctgcaccctgcccggggcctgcaacatccccgccaatgtgagcaactgcaactggttctgtgagggctccttcaatggcagtgagaaggagaccatgcagttcctgaacgaccgcctggccagctacctggagaaggtgcgtcagctggagcgggacaacgcggagctggagaacctcatccgggagcggtcacagcagcaggagcccttggtgtgtgccagctaccagtcctacttcaagaccattgaggagctccagcagaagatcctgtgcagcaagtctgagaatgccaggcttgtggtgcagatcgacaatgccaagctggcctcagatgacttcaggaccaaatatgagaccgagctgtccctgcggcagctggtggagtcggacatcaatggcctgcgcaggatcctggatgagctgaccctgtgcaggtctgacctggaggcccaggtggagtccctgaaggaggagctgctgtgcctcaagcagaaccatgagcaggaggttaacaccctgcgctgccagcttggagaccgcctcaacgtggaggtggacgctgctcccactgtggacctgaaccaggtcctgaatgagaccaggagtcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacggtcaatgccctggagatcgagctgcaggcccagcacaacctgcgagactctctggaaaacacgctgacagagagcgaggcccgctacagctcccagctgtcccaggtgcagagactgatcaccaacgtggagtcccagctggcggagatccgcagtgacctggagcggcagaaccaggagtatcaggtgctgctggacgtgcgggcgcggctggagtgtgagatcaacacgtaccggagcctgctggagagcgaggactgcaagctcccctccaacccctgcgccacaaccaatgcatgtgacaagtccactgggccctgtatctctaatccctgtggcctacgtgctcggtgtgggccttgcaacacatttgggtactagaggccccacaaccaggaggagaagaaa

SEQ ID NO: 145440 - DNA, 1287 bp, Homo sapiens; identical to SEQ ID NO: 145439
  Payload ID: 8760
  Gene Symbol: KRT33A
  Gene Name: keratin 33A, type I
  Uniprot ID: O76009
  ENST ID: ENST00000576236
  CDS Start-End: 46-1260

SEQ ID NO: 145441 - DNA, 1607 bp, Homo sapiens
  Payload ID: 8761
  Gene Symbol: KRT33B
  Gene Name: keratin 33B, type I
  Uniprot ID: Q14525
  ENST ID: ENST00000251646
  CDS Start-End: 51-1265
ggaatcaggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgagcaactgcaactggttctgcgagggctccttcaatggcagcgagaaggagactatgcagttcctgaacgaccgcctggccagctacctggagaaggtgcgtcagctggagcgggacaacgcggagctggagaacctcatccgggagcggtctcagcagcaggagcccttgctgtgccccagctaccagtcctacttcaagaccattgaggagctccagcagaagatcctgtgcagcaagtctgagaatgccaggctggtggtgcagatcgacaatgccaagctggctgcagatgacttcagaaccaagtaccagacggagcagtccctgcggcagctggtggagtccgacatcaacagcctgcgcaggattctggatgagctgaccctgtgcaggtctgacctggaggcccagatggagtccctgaaggaggagctgctgtccctcaagcagaaccatgagcaggaagtcaacaccttgcgctgccagcttggagaccgcctcaacgtggaggtggacgctgctcccgctgtggacctgaaccaggtcctgaacgagaccaggaatcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacagtcaatgccctggagatcgagctgcaggcccagcacaacctgcgatactctctggaaaacacgctgacagagagcgaggcccgctacagctcccagctgtcccaggtgcagagcctgatcaccaacgtggagtcccagctggcggagatccgcagtgacctggagcggcagaaccaggagtatcaggtgctgctggacgtgcgggcgcggctggagtgtgagatcaacacataccggagcctgctggagagcgaggactgcaagctgccctccaacccctgcgccaccaccaatgcatgtgaaaagcccattggatcctgtgtcaccaatccttgtggtcctcgttcccgctgtgggccttgcaacacctttgggtactagataccctggggccagcagaagtatagcatgaagacagaactaccatcggtgggccagttctgcctctctgacaaccatcagccaccggaccccaccccgaggcatcaccacaaatcatggtctggaaggagaacaaatgcccagcgtttgggtctgactctgagcctagggctacttgatcctcctcaccccaggtccctctcctgtagtcagtctgagttctgatggtcagaggttggagctgtgacagtggcatacgaggtgttttgttctctctgctgcttctacctttattgcagttccccaaatcgcctaataaactttcctcttgcaaagcagaca

SEQ ID NO: 145442 - DNA, 1607 bp, Homo sapiens; identical to SEQ ID NO: 145441
  Payload ID: 8761
  Gene Symbol: KRT33B
  Gene Name: keratin 33B, type I
  Uniprot ID: Q14525
  ENST ID: ENST00000570596
  CDS Start-End: 51-1265

SEQ ID NO: 145443 - DNA, 1751 bp, Homo sapiens
  Payload ID: 8762
  Gene Symbol: KRT34
  Gene Name: keratin 34, type I
  Uniprot ID: O76011
  ENST ID: ENST00000394001
  CDS Start-End: 32-1342
aaaattagctgaagcattaggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaagattctgtgtgccaaggctgagaatgccaggctggtggtgaacattgacaatgccaagctggcctctgacgacttcagaagcaagtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggaggttaacaccctgcgctcccagcttggagaccgcctcaacgtggaggtggacactgcccccactgtggacctgaaccaggtcctgaacgagaccaggagtcagtatgaggctctggtggaaattaaccgcagggaagtggagcaatggttcgccacgcagaccgaggagctgaacaagcaggtggtatccagctcagagcagctgcagtcctgccaggcggagatcatcgagctgagacgcacagtcaacgccctggagatcgagctgcaggcccagcacaacctgcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataataaatgtttctcattcata

SEQ ID NO: 145444 - DNA, 1732 bp, Homo sapiens
  Payload ID: 8762
  Gene Symbol: KRT34
  Gene Name: keratin 34, type I
  ENST ID: ENST00000571312
  CDS Start-End: 32-1342
aaaattagctgaagcattaggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcgtacttcaagaccattgaggagctccagcagaagattctgtgtgccaaggctgagaatgccaggctggtggtgaacattgacaatgccaagctggcctctgacgacttcagaagcaagtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggaggttaacaccctgcgctcccagcttggagaccgcctcaacgtggaggtggacactgcccccactgtggacctgaaccaggtcctgaacgagaccaggagtcagtatgaggctctggtggaaactaaccgcagggaagtggagcaatggttcgccacgcagaccgaggagctgaacaagcaggtggtatccagctcagagcagctgcagtcctgccaggcggagatcatcgagctgagacgcacagtcaacgccctggagatcgagctgcaggcccagcacaacctgcgagactctctggaaaacacgctgacggagagcgaggcccgctacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataa

SEQ ID NO: 145445 - DNA, 1778 bp, Homo sapiens
  Payload ID: 8763
  Gene Symbol: KRT35
  Gene Name: keratin 35, type I
  ENST ID: ENST00000246639
  CDS Start-End: 134-1411
ctggcctcagagacctatcaattgcatctgagttgcaggggccatggcttccaaatgcctcaaggccggcttctcttctgggtctctcaagagcccaggaggggccagtgggggctccactcgtgtgtccgcaatgtactccagcagctcttgcaagcttccaagtctctcccctgtggccagaagtttctctgcctgctcagtgggtctgggcagaagcagctacagggccaccagctgcctccctgctctctgcctccctgctggaggcttcgctaccagctacagtgggggtgggggctggtttggggagggcatcctcactggcaatgagaaggagaccatgcaatccctgaacgaccgcctggccggctacctggagaaggtgcgtcagctggagcaggagaacgccagcctggagagccgcatccgtgagtggtgtgagcagcaggtcccctacatgtgccctgactaccagtcctacttccggaccatcgaggagctccagaagaagactctatgcagcaaggctgagaatgccaggctggtggtggagattgacaatgccaaattggctgcagatgacttcaggaccaagtatgagacggaggtgtccctgcggcagctggtggagtcagacatcaacggcctgcgcaggatcctggatgacctgaccctgtgcaagtctgacctggaggcccaggtggagtccctgaaggaggagctgctctgcctgaagaagaaccatgaggaggaagtgaactcactgcgctgccaacttggtgaccgcctcaatgttgaggtggacgctgccccacctgttgacctgaaccgagttctggaggagatgaggtgccagtatgaaaccctggtggagaataaccgccgggatgctgaagactggttggacacccagagtgaggagctgaaccagcaggtggtgtccagctcagagcagttgcagtcctgccaggcagagatcatcgagctgagacgcacggtcaacgccctggagattgagctgcaggctcagcacagcatgagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcccccgccccatttgtgtgccctgcccagggggtcggttctgagagcgggtgacccagatggccatggctattgtctccagggcttgaacttggcctctacccaaacttaacccttgtagcccaatcccctctcttcgcgcagagcccaggcccagggtctggctgaaaaggctttctgcaaatacatgccctaaagtttctcagagcctgtcacaaaggccggctgcccccaaaggtctcaactcctcatcatttcaatgggtgccagggtctctgttctcaggctgcctcctgggtcaggttttccttctaggtgctgttccggtggattctgaaatgcagtagagggcttttgttggcagaacaataaagtgcatttgctcaggcccctgatgcctaacttgcacca

SEQ ID NO: 145446 - DNA, 1670 bp, Homo sapiens
  Payload ID: 8763
  Gene Symbol: KRT35
  Gene Name: keratin 35, type I
  Uniprot ID: Q92764
  ENST ID: ENST00000393989
  CDS Start-End: 44-1411
ctggcctcagagacctatcaattgcatctgagttgcaggggccatggcttccaaatgcctcaaggccggcttctcttctgggtctctcaagagcccaggaggggccagtgggggctccactcgtgtgtccgcaatgtactccagcagctcttgcaagcttccaagtctctcccctgtggccagaagtttctctgcctgctcagtgggtctgggcagaagcagctacagggccaccagctgcctccctgctctctgcctccctgctggaggcttcgctaccagctacagtgggggtgggggctggtttggggagggcatcctcactggcaatgagaaggagaccatgcaatccctgaacgaccgcctggccggctacctggagaaggtgcgtcagctggagcaggagaacgccagcctggagagccgcatccgtgagtggtgtgagcagcaggtcccctacatgtgccctgactaccagtcctacttccggaccatcgaggagctccagaagaagactctatgcagcaaggctgagaatgccaggctggtggtggagattgacaatgccaaattggctgcagatgacttcaggaccaagtatgagacggaggtgtccctgcggcagctggtggagtcagacatcaacggcctgcgcaggatcctggatgacctgaccctgtgcaagtctgacctggaggcccaggtggagtccctgaaggaggagctgctctgcctgaagaagaaccatgaggaggaagtgaactcactgcgctgccaacttggtgaccgcctcaatgttgaggtggacgctgccccacctgttgacctgaaccgagttctggaggagatgaggtgccagtatgaaaccctggtggagaataaccgccgggatgctgaagactggttggacacccagagtgaggagctgaaccagcaggtggtgtccagctcagagcagttgcagtcctgccaggcagagatcatcgagctgagacgcacggtcaacgccctggagattgagctgcaggctcagcacagcatgagagatgctttggaatccaccctggcagagacggaggcccgctatagctcccagctggcccagatgcagtgcatgatcaccaacgtggaggcccagctggccgagatccgggctgacctggagcggcagaaccaggagtaccaggtgctgctggacgtccgggcccggctggagtgtgagatcaacacgtaccggggcctgctggagagtgaggacagcaagctcccctgtaacccatgtgcacctgactactcaccctccaagtcatgccttccctgtcttcctgcggcctcctgcggtcctagtgcagcccgcacaaactgcagcccccgccccatttgtgtgccctgcccagggggtcggttctgagagcggggtctggctgaaaaggctttctgcaaatacatgccctaaagtttctcagagcctgtcacaaaggccggctgcccccaaaggtctcaactcctcatcatttcaatgggtgccagggtctctgttctcaggctgcctcctgggtcaggttttccttctaggtgctgttccggtggattctgaaatgcagtagagggcttttgttggcagaacaataaagtgcatttgctcaggcccctgatgcctaacttgcacc

SEQ ID NO: 145447 - DNA, 1644 bp, Homo sapiens
  Payload ID: 8764
  Gene Symbol: KRT36
  Gene Name: keratin 36, type I
  Uniprot ID: O76013
  ENST ID: ENST00000328119
  CDS Start-End: 1-1404
atggccacccagacctgcacccctaccttctccactgggtctatcaagggcctctgtggcacagcaggcggcatctctcgggtgtcctccatccgttctgtgggctcctgcagggtccccagtctcgccggtgctgcagggtacatctcttctgctaggtcgggcctctctggccttgggagctgcttgcctggctcctacctgtcttctgagtgccacacctctggctttgtggggagcgggggctggttctgcgagggctccttcaacggcagcgagaaggagactatgcagttcctgaacgaccgcctggccaactacctggagaaggtgcgtcagctggagcgggagaacgcggagctggagagccgcatccaggagtggtacgagtttcagatcccatacatctgcccagactaccagtcctacttcaagaccatcgaagatttccagcagaagatcctgctgactaagtctgagaatgccaggctggtcctgcagattgataatgccaagctggctgctgacgacttccggaccaagtatgagacagagctgtctctgcggcagctagtggaggccgacatcaacggcctgcgtaggatcctggatgagctgaccctgtgcaaggctgacctggaggctcaggtggagtccctgaaggaggagctgatgtgcctcaagaagaatcacgaggaggaagtcagtgtactccgttgccaacttggggaccgactgaatgtggaggtggacgctgctcccccagtggatctcaacaagatcctggaggatatgagatgccagtacgaggccctggtggagaataaccgcagagatgtggaggcctggttcaacacccagactgaggagctgaaccagcaggtggtgtccagctcggagcagctgcagtgctgccagacggagatcatcgagctgagacgtacggtcaacgcgctagagattgagctgcaggctcagcacagcatgcggaattccttggaatccaccctggccgaaaccgaggcccgctacagctcccagctggcccagatgcagtgcctgatcagcaacgtggaggcccagctgtctgagatccgctgcgacctggagcggcagaaccaggagtaccaggtgttactggacgtcaaggcccggctggagggcgagatcgctacctaccgccacctgctggagggagaggactgcaagcttcctccccaaccttgtgccacggcatgcaagcctgttattagagttccttctgtccccccggtgccctgtgtcccctctgtgccctgcaccccggctccccaggttggcactcagatccgcaccatcaccgaggagatcagagatgggaaagtcatctcctccagggagcacgtgcagtcccgcccgctgtgacagcccacttggtccaccagggcagggccctgaccacaggaaggaggacacccctgtggctcctggaggcttaacgaccctgcccttctctagaggggtccccctacgcttagcaggtttttctaccaaaacactccccgtattgtgtttccggacttaactgtgcttttacgccatgcaaaaccaggtttcctggaaatttacccaataaagtgtgttctcctggcatagcaaactcaa

SEQ ID NO: 145448 - DNA, 1707 bp, Homo sapiens
  Payload ID: 8764
  Gene Symbol: KRT36
  Gene Name: keratin 36, type I
  Uniprot ID: O76013
  ENST ID: ENST00000393986
  CDS Start-End: 214-1467
gcagcttgaacttagttctcgctgagtcccggctcagggcccttcccttgggtcggggggttggctgtgcagtcaacaataaggaaaaaggcaagacactgagggcagctgaaagacttttacctttgacgagctggtcacctgctccagggaaggtacattcctctccccacaaccctagaggcacctctctggtccacagtgtccctcctgatgctcaggtcgggcctctctggccttgggagctgcttgcctggctcctacctgtcttctgagtgccacacctctggctttgtggggagcgggggctggttctgcgagggctccttcaacggcagcgagaaggagactatgcagttcctgaacgaccgcctggccaactacctggagaaggtgcgtcagctggagcgggagaacgcggagctggagagccgcatccaggagtggtacgagtttcagatcccatacatctgcccagactaccagtcctacttcaagaccatcgaagatttccagcagaagatcctgctgactaagtctgagaatgccaggctggtcctgcagattgataatgccaagctggctgctgacgacttccggaccaagtatgagacagagctgtctctgcggcagctagtggaggccgacatcaacggcctgcgtaggatcctggatgagctgaccctgtgcaaggctgacctggaggctcaggtggagtccctgaaggaggagctgatgtgcctcaagaagaatcacgaggaggaagtcagtgtactccgttgccaacttggggaccgactgaatgtggaggtggacgctgctcccccagtggatctcaacaagatcctggaggatatgagatgccagtacgaggccctggtggagaataaccgcagagatgtggaggcctggttcaacacccagactgaggagctgaaccagcaggtggtgtccagctcggagcagctgcagtgctgccagacggagatcatcgagctgagacgtacggtcaacgcgctagagattgagctgcaggctcagcacagcatgcggaattccttggaatccaccctggccgaaaccgaggcccgctacagctcccagctggcccagatgcagtgcctgatcagcaacgtggaggcccagctgtctgagatccgctgcgacctggagcggcagaaccaggagtaccaggtgttactggacgtcaaggcccggctggagggcgagatcgctacctaccgccacctgctggagggagaggactgcaagcttcctccccaaccttgtgccacggcatgcaagcctgttattagagttccttctgtccccccggtgccctgtgtcccctctgtgccctgcaccccggctccccaggttggcactcagatccgcaccatcaccgaggagatcagagatgggaaagtcatctcctccagggagcacgtgcagtcccgcccgctgtgacagcccacttggtccaccagggcagggccctgaccacaggaaggaggacacccctgtggctcctggaggcttaacgaccctgcccttctctagaggggtccccctacgcttagcaggtttttctaccaaaacactccccgtattgtgtttccggacttaactgtgcttttacgccatgcaaaaccaggtttcctggaaatttacccaataaagtgtgttctcctggcatagcaaactcaa

SEQ ID NO: 145449 - DNA, 1475 bp, Homo sapiens
  Payload ID: 8765
  Gene Symbol: KRT37
  Gene Name: keratin 37, type I
  Uniprot ID: O76014
  ENST ID: ENST00000225550
  CDS Start-End: 1-1350
atgacctccttctacagcacctcctcatgccctctgggttgcaccatggctcctggagcaagaaatgtctttgtctctcctatcgatgttgggtgccagcctgtggcagaggccaatgctgcctccatgtgcctcttggccaacgtggcacacgccaacagagtccgtgtggggtcgactcccctgggccgccccagcctctgtctgcccccaaccagtcacactgcttgtcccttgccagggacctgtcacattcccggcaacatcggaatctgtggggcctacggcaaaaacaccctgaatggccatgagaaggagaccatgaagttcctgaatgaccgcctggccaactacctggagaaggtgcgccagctggagcaggagaatgcagagctggagaccacactcctcgagaggagcaagtgccacgagtccaccgtgtgccccgactaccagtcctacttccgtacaatcgaggagctccagcagaagatcctgtgcagcaaggctgagaatgccaggctgattgtacaaattgacaacgcgaagctggctgctgatgactttaggatcaagctggagagtgagcgctcccttcaccagctggtggaggcggacaagtgcgggacgcagaagctcctggatgacgcgaccctggccaaggccgacctggaggcccagcaggagtccctgaaggaggagcagctctccctcaagagcaaccacgagcaggaagtaaagattctgaggagtcagctgggggagaagttccggatcgagctggacattgagcccaccattgacctgaacagggtgttgggggagatgcgggctcagtacgaggccatggtggagaccaaccaccaggatgtggaacagtggttccaagcccagtctgaaggcatcagcctgcaggccatgtcctgctccgaggagctgcagtgctgccagtcggagatcctggagctgagatgcacggtgaatgccctggaggtggagcgccaagcccagcacaccttgaaggactgtctgcagaactccctgtgtgaagcggaggaccgctacggcacagagctggcccagatgcagagcctcattagcaacttggaagagcagttgtctgagatccgggccgacctggagcggcagaaccaggagtaccaggtgctgctggacgtgaaggcccggttggagaacgagattgccacataccggaaccttctggagagcgaggactgcaaactcccctgcaatccctgttccacgcctgcctcctgtacttcttgtccaagctgtggccctgtcaccggtgggtctccctctggccatggagccagcatggggagatgattctgaaggcccgagttaggagattgaggctggttgcactggggtcaggagtgccctcaccttgcccagtcttccttcaagactagactcactgaggcattttccctaaatcaaccggtagcaga

SEQ ID NO: 145450 - DNA, 1475 bp, Homo sapiens; identical to SEQ ID NO: 145449
  Payload ID: 8765
  Gene Symbol: KRT37
  Gene Name: keratin 37, type I
  Uniprot ID: O76014
  ENST ID: ENST00000574588
  CDS Start-End: 1-1350

SEQ ID NO: 145451 - DNA, 2337 bp, Homo sapiens
  Payload ID: 8766
  Gene Symbol: KRT38
  Gene Name: keratin 38, type I
  Uniprot ID: O76015
  ENST ID: ENST00000246646
  CDS Start-End: 1-1371
atgacctcttcctacagcagctcctcatgccctctgggttgcaccatggctcctggagcaagaaatgtctctgtctctcccatcgacattgggtgccagcctggggcagaggccaacattgcccccatgtgccttttggccaacgtggcacatgccaaccgagtccgtgtggggtccactcccctgggccgccccagcctctgtctgccgcctacctgccacactgcttgtcccttgccagggacctgccacattcctggcaacattggaatctgtggggcctatggtgaaaacaccctgaatggccatgagaaggagaccatgcagttcctgaatgaccgcctggccaactacctggagaaggtgcgccagctggagcaggagaatgcggagctggaggccacactcctcgagaggagcaagtgccacgagtccaccgtgtgccccgactaccagtcttacttccacaccatcgaggagctccaacagaagatcctgtgcagcaaggccgagaatgccaggctgattgtacaaattgacaatgccaagctggctgccgatgactttaggatcaagctggagagtgagcgctccctgcgccagctggtggaggcagacaagtgtgggacacagaagctcctggatgatgcgaccctggccaaggccgacctggaggcccagcaggagtccctgaaggaggagcagctctccctcaagagcaaccacgagcaggaagtaaagattctgaggagtcagctgggggagaagctccggattgagctggacattgagcccaccattgacctgaacagggtgctgggggagatgcgggctcagtatgaggccatgttggagaccaaccgccaggatgtggaacagtggttccaagcccagtctgaaggcatcagcctgcaggacatgtcctgctccgaggagctgcagtgctgccagtcggagatcctggagctgagatgcacggtgaatgccctggaggtggagcgccaagcccagcacaccttgaaggactgtctgcagaactccctgtgtgaagccgaggaccgcttcggcacggagctggcccagatgcagagcctcatcagcaacgtggaggagcagctgtctgagatccgggccgacctggagcggcaaaaccaggagtaccaggtgctgctggacgtgaagacccggctggagaatgagattgccacgtaccggaaccttctggaaagcgaggactgcaaactcccctgcaatccgtgctccacgtctccctcctgcgtgactgccccctgtgctcctcgcccaagctgtggcccctgcaccacctgtgggcccacctgtggagccagcaccaccggaagccgattctgaattcctgtggacccacaggggctggctaaggcgagggatacccaaagagagatgcttgttatacctttagaaaatctggcttctaactttctgtatgtataggcctgtccaaaggctatgagataccagggacagtggaatcttgatggaaatccttcctttcctgctcttggttttcccaggtgagctctatgccctcagtggctggattgcagccacccatggtggctcagaatatctggattggagaggcataaggttgaaaagcattttggagtaggaacacggcatgatttaaaattgcacttgcacttcaagaacaccaactttaacttgaaatttttatagtttatgacaaaggaagtgaagaacagacttcactgtctgagatttcccacatttcttgggttgtttctaacattggcagcctggattatggccctagggagagggaaatagaatcagaattgtacctgaccctgtcttttctaattcccttctcctatcctcctgcctccctatcttggaaactgattaagtggaaactttccttgtatcaaatcctgagttttctctacttcagggtttctagctttgacaaaggaccaggcttgccttttctgtggcaacacagcctcttacatatggcttccatagcttcttgctatgtgaaaggaactttcagattaagaaatttctctcttttttctctataaattctgactctccagacttgtctggctataacccctgtccctgtctaattctcccagtctaaaatctaaacaatgacttcatttttttctagtactttctcctgaagtattgaaacctattgattcaatgggtagagatttgctaagtatgatgtgcttccacctcttctcttcatactctctaccttccttaccatgattcagccacactggcctttctgttccttggacatgcctggagacctgtccc

SEQ ID NO: 145452 - DNA, 1696 bp, Homo sapiens
  Payload ID: 8767
  Gene Symbol: KRT39
  Gene Name: keratin 39, type I
  Uniprot ID: Q6A163
  ENST ID: ENST00000355612
  CDS Start-End: 37-1512
cacagacctggaacaaactaaagccagacacatactatggacaccaagggctgtacaacaaccaattctccttcaaccccatgtcaaaactgctctaggattacaaatgttagtaccatctcttctaacaacggctgccatcctggtggccttacagtcaacaactgtcaaccagctggccacgttctcagaattccctgggaccagggctgccaacccactcctcgcttttgtcgcaagcccatctacctaatgaacaacttcaatgcccgtttttctctggatgactgcagctggtatggtgaaggcatcaacagtaatgagaaggagaccatgcaaatcttgaacgagcgccttgctaactacctgcaaaaggtgcgaatgctagaacgagagaatgctgaactggaatctaaaatccaggaagaaagtaacaaagagctccctgttctatgtcctgattacctgtcttactacactaccattgaggagctccagcagaagatcttgtgtaccaaggccgagaattccagactggtctcgcaaattgacaacaccaaactgactgcagatgacttgagagccaaatacgaagctgaggtgtctctacgccagctggtagagtcagatgccaatggcctcaagcagatcctgaatgtgctgaccctgggcaaggccgacctagaggcacaagtccagtctctgaaagaggagctcctttgcctcaagaacaaccacaaagaggaaatcaattctttacagtgtcagcttggggagagacttgacattgaagtgactgctgccccttctgctgacctaaaccaggttctacaagaaatgagatgtcaatatgagcccatcatggagacaaaccgcaaagatgtggaacagtggttcaacacgcagatagaggagctgaatcaacaagtggtgaccagctctcaacagcagcaatgctgccaaaaggagatcatagaactgagacgcagtgtgaacactctggaggttgaactgcaggcccagcatcgaatgagagattcccaagagtgcatcctaacggagacagaggctcgctacacggccttgctgacccagatccagagtctgattgataacctggaagctcagctggcagagatccggtgtgccctggaaagacagaaccaagaatacgagatcctgctggacgtcaagtcccggctggaatgtgagattaccacataccgcagccttctggagagctcggatggcaagcgtccctgttacccacgtgccaccaaatgtgagccttccccttggacatcttgtaagtccggagccatagaaagcacggccccagcttgcacatcctcatccccctgcagcttaaaggagcactgcagtgcctgcggacccctgtcccggatactggttaaaatttgcaccatcaccaaggagattaaggatgggaaggtcatttcttcttacgagcatgtgcagccttgtttcatcatcagacctgccaaagtctaacatcccaaggtgatgaaaatgacccacatttatgaaacagaggccaatacatgctcctgccagagaggtttaagaaaactccccagtcccttaaggtacttagtttcttactactacagcgggtccccattgctaggtagaatatcttttattctgctccttccctaactcaccactgctaaca

SEQ ID NO: 145453 - DNA, 1696 bp, Homo sapiens; identical to SEQ ID NO: 145452
  Payload ID: 8767
  Gene Symbol: KRT39
  Gene Name: keratin 39, type I
  Uniprot ID: Q6A163
  ENST ID: ENST00000575391
  CDS Start-End: 37-1512

SEQ ID NO: 145454 - DNA, 1689 bp, Homo sapiens
  Payload ID: 8767
  Gene Symbol: KRT39
  Gene Name: keratin 39, type I
  ENST ID: ENST00000580328
  CDS Start-End: 31-585
cctggaacaaactaaagccagacacatactatggacaccaagggctgtacaacaaccaattctccttcaaccccatgtcaaaactgctctaggattacaaatgttagtaccatctcttctaacaacggctgccatcctggtggccttacagtcaacaactgtcaaccagctggccacgttctcagaattccctgggaccagggctgccaacccactcctcgcttttgtcgcaagcccatctacctaatgaacaacttcaatgcccgtttttctctggatgactgcagctggtatggtgaaggcatcaacagtaatgagaaggagaccatgcaaatcttgaacgagcgccttgctaactacctgcaaaaggtgcgaatgctagaacgagagaatgctgaactggaatctaaaatccaggaagaaagtaacaaagagctccctgttctatgtcctgattacctgtcttactacactaccattgaggagctccagcagaagatcttgtgtaccaaggccgagaattccagactggtctcgcaaattgacaacaccaaactgactgcagatgacttgagagccaagtgagaaatctgtggcttagtgaggctaagttactcacccaaagatacgaagctgaggtgtctctacgccagctggtagagtcagatgccaatggcctcaagcagatcctgaatgtgctgaccctgggcaaggccgacctagaggcacaagtccagtctctgaaagaggagctcctttgcctcaagaacaaccacaaagaggaaatcaattctttacagtgtcagcttggggagagacttgacattgaagtgactgctgccccttctgctgacctaaaccaggttctacaagaaatgagatgtcaatatgagcccatcatggagacaaaccgcaaagatgtggaacagtggttcaacacgcagatagaggagctgaatcaacaagtggtgaccagctctcaacagcagcaatgctgccaaaaggagatcatagaactgagacgcagtgtgaacactctggaggttgaactgcaggcccagcatcgaatgagagattcccaagagtgcatcctaacggagacagaggctcgctacacggccttgctgacccagatccagagtctgattgataacctggaagctcagctggcagagatccggtgtgccctggaaagacagaaccaagaatacgagatcctgctggacgtcaagtcccggctggaatgtgagattaccacataccgcagccttctggagagctcggatggcaagcgtccctgttacccacgtgccaccaaatgtgagccttccccttggacatcttgtaagtccggagccatagaaagcacggccccagcttgcacatcctcatccccctgcagcttaaaggagcactgcagtgcctgcggacccctgtcccggatactggttaaaatttgcaccatcaccaaggagattaaggatgggaaggtcatttcttcttacgagcatgtgcagccttgtttcatcatcagacctgccaaagtctaacatcccaaggtgatgaaaatgacccacatttatgaaacagaggccaatacatgctcctgccagagaggtttaagaaaactccccagtcccttaaggtacttagtttcttactactacagcgggtccccattgctaggta

SEQ ID NO: 145455 - DNA, 1689 bp, Homo sapiens; identical to SEQ ID NO: 145454
  Payload ID: 8767
  Gene Symbol: KRT39
  Gene Name: keratin 39, type I
  ENST ID: ENST00000578078
  CDS Start-End: 31-585

SEQ ID NO: 145456 - DNA, 558 bp, Homo sapiens
  Payload ID: 8768
  Gene Symbol: KRT4
  Gene Name: keratin 4, type II
  ENST ID: ENST00000552668
  CDS Start-End: 59-319
actcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcacgacaaggaggtcaccatcaaccagagcttgctcacccccctccacgtggagattgaccctgagatccagaaagtccggacggaagagcgcgaacagatcaagctcctcaacaacaagtttgcctccttcatcgacaaggtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcg

SEQ ID NO: 145457 - DNA, 2576 bp, Homo sapiens
  Payload ID: 8768
  Gene Symbol: KRT4
  Gene Name: keratin 4, type II
  Uniprot ID: P19013
  ENST ID: ENST00000551956
  CDS Start-End: 494-2056
gacttgctccggtttgcagagctaggaggtggcaggctgtgcgctcaaactcaggctgtctaactccacattctgtggggtgagaggatgggtgatggggtgtcttttctggaggagggaggtgctgtgagcctagcgagatggaggtacagtgggtgtgggcctggagcgctgggcccaggcaggggcttctgattaggaagccctggggcaccagttcaggttctcccagagagtagtgtgatgggatccagtaacctgtgccctccagatgacttctgtaggtgtgtttagtgacatgctcaacgggtgcgggaaggatgggcttgtgccaagggccaagcccagagatgtttcagatttttccctttatgcccctgcaaccaagccctgctgctccaggacatataagagacgaaggctgagggctccagcactcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcacgacaaggtgcctgctttgggggtgctggaggctttggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatggacagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 145458 - DNA, 1839 bp, Homo sapiens
  Payload ID: 8768
  Gene Symbol: KRT4
  Gene Name: keratin 4, type II
  ENST ID: ENST00000548097
  CDS Start-End: 59-295
actcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcacgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatggacagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcatt

SEQ ID NO: 145459 - DNA, 1812 bp, Homo sapiens
  Payload ID: 8769
  Gene Symbol: KRT40
  Gene Name: keratin 40, type I
  Uniprot ID: Q6A162
  ENST ID: ENST00000377755
  CDS Start-End: 36-1331
ttttgcagccagtctctgtctttgcttctggaaggatgacttctgactgctcctccacacactgctctcctgagtcctgtggcacggcttccggttgtgcacctgcctcaagctgctccgtggaaacagcttgtctccccggtacctgtgctacatcccgatgtcagactccaagcttcctatccaggtctcgcgggctgactggttgcctcctgccatgctactttactgggagttgtaatagtccctgcttggtggggaactgtgcctggtgtgaggatggggtgttcactagcaatgagaaggagacgatgcagttcctgaatgacagactcgccagctatctggagaaggtgcgcagcctggaggagaccaacgcagagctggaatccaggatccaagaacaatgtgaacaggatatcccaatggtgtgcccggattatcagcgttacttcaacaccattgaagatctccaacaaaagatcttatgcacgaaagcagagaattctagacttgctgtacagcttgacaactgcaaactggccactgatgactttaagtcaaagtacgagagtgaactgtcccttcgccagctgttagaggctgacatcagcagcctgcatgggatcctggaggaactgaccctgtgcaaatctgatctggaggcccatgtggagtctctgaaggaagatctcctttgccttaagaaaaaccatgaagaggaagtcaacttgcttcgtgaacagcttggcgaccgcctcagtgtggagctggacactgcccccacccttgacctcaacagggtcctggatgagatgcgctgtcagtgtgaaacggtgcttgccaacaatcgcagagaagctgaagaatggttggctgttcagacagaagagctgaatcagcagcaactgtccagcgcggagcagctgcagggctgccagatggagatcttggaactgaaacgcacagccagtgctctggaaattgagctccaagcacagcaaagcctgacagaatctctggaatgcaccgtggcagaaaccgaggcccagtacagctcccagctggcccaaattcagtgtctgatcgataacctggagaaccagctggccgagatccgctgcgacctggagcgacagaaccaggagtaccaggtgctcctggacgtgaaggcccggctggagggtgagatcaacacgtactggggcctgctggacagcgaggacagcaggctttcctgtagcccatgttcgaccacatgcacctcgagcaacacttgtgagccatgctcagcctatgtcatctgcactgttgaaaactgctgcttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcgtggtaaatatagctctatggctgattactgttgatagaatattcattttatggcaaggaaatcatctaaacccataaccatagtttcaatgtacataaacccaggctgaaaatattttttaactcctcaaatacaaataaattaatgaacccatgagaaatgtcatatatcttagaaaatagttgtgtgtatctttctgaggaaaaatattaggaataaaatatgataaaatgt

SEQ ID NO: 145460 - DNA, 1772 bp, Homo sapiens
  Payload ID: 8769
  Gene Symbol: KRT40
  Gene Name: keratin 40, type I
  Uniprot ID: Q6A162
  ENST ID: ENST00000398486
  CDS Start-End: 162-1457
gctatagcagagatgcgtgcaaagtgctctgggaggagccacatctccacatgaggcagttgaacgacgtttcagctgagtcttgacatctgaaggtctggtgatagctgggtgcaggaatattgtgcaggagggctatgtgtcctggaccatgaagaaggatgacttctgactgctcctccacacactgctctcctgagtcctgtggcacggcttccggttgtgcacctgcctcaagctgctccgtggaaacagcttgtctccccggtacctgtgctacatcccgatgtcagactccaagcttcctatccaggtctcgcgggctgactggttgcctcctgccatgctactttactgggagttgtaatagtccctgcttggtggggaactgtgcctggtgtgaggatggggtgttcactagcaatgagaaggagacgatgcagttcctgaatgacagactcgccagctatctggagaaggtgcgcagcctggaggagaccaacgcagagctggaatccaggatccaagaacaatgtgaacaggatatcccaatggtgtgcccggattatcagcgttacttcaacaccattgaagatctccaacaaaagatcttatgcacgaaagcagagaattctagacttgctgtacagcttgacaactgcaaactggccactgatgactttaagtcaaagtacgagagtgaactgtcccttcgccagctgttagaggctgacatcagcagcctgcatgggatcctggaggaactgaccctgtgcaaatctgatctggaggcccatgtggagtctctgaaggaagatctcctttgccttaagaaaaaccatgaagaggaagtcaacttgcttcgtgaacagcttggcgaccgcctcagtgtggagctggacactgcccccacccttgacctcaacagggtcctggatgagatgcgctgtcagtgtgaaacggtgcttgccaacaatcgcagagaagctgaagaatggttggctgttcagacagaagagctgaatcagcagcaactgtccagcgcggagcagctgcagggctgccagatggagatcttggaactgaaacgcacagccagtgctctggaaattgagctccaagcacagcaaagcctgacagaatctctggaatgcaccgtggcagaaaccgaggcccagtacagctcccagctggcccaaattcagtgtctgatcgataacctggagaaccagctggccgagatccgctgcgacctggagcgacagaaccaggagtaccaggtgctcctggacgtgaaggcccggctggagggtgagatcaacacgtactggggcctgctggacagcgaggacagcaggctttcctgtagcccatgttcgaccacatgcacctcgagcaacacttgtgagccatgctcagcctatgtcatctgcactgttgaaaactgctgcttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcgtggtaaatatagctctatggctgattactgttgatagaatattcattttatggcaaggaaatcatcta

SEQ ID NO: 145461 - DNA, 2102 bp, Homo sapiens
  Payload ID: 8769
  Gene Symbol: KRT40
  Gene Name: keratin 40, type I
  ENST ID: ENST00000461923
  CDS Start-End: 153-863
aaaatagtacctacgaagcttgaaggatggctggagcttagggtttgtgagacagaacatcaggaagtgagcccagaaagctgaaggtctggtgatagctgggtgcaggaatattgtgcaggagggctatgtgtcctggaccatgaagaaggatgacttctgactgctcctccacacactgctctcctgagtcctgtggcacggcttccggttgtgcacctgcctcaagctgctccgtggaaacagcttgtctccccggtacctgtgctacatcccgatgtcagactccaagcttcctatccaggtctcgcgggctgactggttgcctcctgccatgctactttactgggagttgtaatagtccctgcttggtggggaactgtgcctggtgtgaggatggggtgttcactagcaatgagaaggagacgatgcagttcctgaatgacagactcgccagctatctggagaaggtgcgcagcctggaggagaccaacgcagagctggaatccaggatccaagaacaatgtgaacaggatatcccaatggtgtgcccggattatcagcgttacttcaacaccattgaagatctccaacaaaagatcttatgcacgaaagcagagaattctagacttgctgtacagcttgacaactgcaaactggccactgatgactttaagtcaaagtacgagagtgaactgtcccttcgccagctgttagaggctgacatcagcagcctgcatgggatcctggaggaactgaccctgtgcaaatctgatctggaggcccatgtggagtctctgaaggaagatctcctttgccttaagaaaaaccatgaagagacgaagaaactgaggcccttctaagtggtgaaaagagattcagcccaggcaatctgaatcaaaatctcacacttttacccactgctccaaaaaacagaagtagaatgccattggatgtcaaatggatttttccccaccattctgtgacattctttacaccatcccactttcaggaagtcaacttgcttcgtgaacagcttggcgaccgcctcagtgtggagctggacactgcccccacccttgacctcaacagggtcctggatgagatgcgctgtcagtgtgaaacggtgcttgccaacaatcgcagagaagctgaagaatggttggctgttcagacagaagagctgaatcagcagcaactgtccagcgcggagcagctgcagggctgccagatggagatcttggaactgaaacgcacagccagtgctctggaaattgagctccaagcacagcaaagcctgacagaatctctggaatgcaccgtggcagaaaccgaggcccagtacagctcccagctggcccaaattcagtgtctgatcgataacctggagaaccagctggccgagatccgctgcgacctggagcgacagaaccaggagtaccaggtgctcctggacgtgaaggcccggctggagggtgagatcaacacgtactggggcctgctggacagcgaggacagcaggctttcctgtagcccatgttcgaccacatgcacctcgagcaacacttgtgagccatgctcagcctatgtcatctgcactgttgaaaactgctgcttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcgtggtaaatatagctctatggctgattactgttgatagaatattcattttatggcaaggaaatcatctaaacccataaccatagtttcaatgtacataaacccaggctgaaaatattttttaactcctcaaatacaaataaattaatgaacccatgagaaatgtcatatatcttagaaaatagttgtgtgtatctttctgaggaaaaatattaggaataaaatatgataaaatgt

SEQ ID NO: 145462 - DNA, 2102 bp, Homo sapiens; identical to SEQ ID NO: 145461
  Payload ID: 8769
  Gene Symbol: KRT40
  Gene Name: keratin 40, type I
  ENST ID: ENST00000576064
  CDS Start-End: 153-863

SEQ ID NO: 145463 - DNA, 1772 bp, Homo sapiens; identical to SEQ ID NO: 145460
  Payload ID: 8769
  Gene Symbol: KRT40
  Gene Name: keratin 40, type I
  Uniprot ID: Q6A162
  ENST ID: ENST00000576967
  CDS Start-End: 162-1457

SEQ ID NO: 145464 - DNA, 1812 bp, Homo sapiens; identical to SEQ ID NO: 145459
  Payload ID: 8769
  Gene Symbol: KRT40
  Gene Name: keratin 40, type I
  Uniprot ID: Q6A162
  ENST ID: ENST00000610983
  CDS Start-End: 36-1331

SEQ ID NO: 145465 - DNA, 2531 bp, Homo sapiens
  Payload ID: 8770
  Gene Symbol: KRT5
  Gene Name: keratin 5, type II
  Uniprot ID: P13647
  ENST ID: ENST00000252242
  CDS Start-End: 392-2164
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatataa

SEQ ID NO: 145466 - DNA, 611 bp, Homo sapiens
  Payload ID: 8770
  Gene Symbol: KRT5
  Gene Name: keratin 5, type II
  ENST ID: ENST00000549420
  CDS Start-End: 76-611
gctgagctctgttctctccagcacctcccaacccactagtgcctggttctcttgctccaccaggaacaagccaccatgtctcgccagtcaagtgtgtccttccggagcgggggcagtcgtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagct

SEQ ID NO: 145467 - DNA, 539 bp, Homo sapiens
  Payload ID: 8770
  Gene Symbol: KRT5
  Gene Name: keratin 5, type II
  ENST ID: ENST00000551275
  CDS Start-End: 99-539
aacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttc

SEQ ID NO: 145468 - DNA, 936 bp, Homo sapiens
  Payload ID: 8770
  Gene Symbol: KRT5
  Gene Name: keratin 5, type II
  ENST ID: ENST00000548409
  CDS Start-End: 1-604
tgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctgtaagtagctttgaacagacattaacaacgacaataatatgggatatatttagtgccaactcagaattctgctgtttctagatccaaacttttcccatcccagcatatggttatttataataatacacttagtaagttgtgggtggtggaggggaaggacagattgggacaggaagcaatgtggcttatgtctcatctcttaaagggtaagccatgcatcctatgcttcttggaccctgtcccctgccttgtccctagtacctagctccccccagtacctagctcctcccctcagtacctagctcccctcagtacctagctccctgtagtacctagctcc

SEQ ID NO: 145469 - DNA, 542 bp, Homo sapiens
  Payload ID: 8770
  Gene Symbol: KRT5
  Gene Name: keratin 5, type II
  ENST ID: ENST00000546577
  CDS Start-End: 147-542
actgtgcaggtgtgaccggtgagctcacagctgccccccaggcatgcccagcccacttaatcattcacagctcgacagctctctcgcccagcccagttctggaagggataaaaagggggcatcaccgttcctgggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggcttt

SEQ ID NO: 145470 - DNA, 587 bp, Homo sapiens
  Payload ID: 8770
  Gene Symbol: KRT5
  Gene Name: keratin 5, type II
  ENST ID: ENST00000551188
  CDS Start-End: 1-587
ggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaacctctgaaagctcaaaaaagaacactagagaaattgactaggtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaaca

SEQ ID NO: 145471 - DNA, 2310 bp, Homo sapiens
  Payload ID: 8771
  Gene Symbol: KRT6A
  Gene Name: keratin 6A, type II
  Uniprot ID: P02538
  ENST ID: ENST00000330722
  CDS Start-End: 70-1764
agtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatggatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcgctgtttgcaattgctaaataaagcagatttataatacaata

SEQ ID NO: 145472 - DNA, 2282 bp, Homo sapiens
  Payload ID: 8772
  Gene Symbol: KRT6B
  Gene Name: keratin 6B, type II
  Uniprot ID: P04259
  ENST ID: ENST00000252252
  CDS Start-End: 49-1743
cgcctccagcctctcacactctcctaagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggcgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggtcgtctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactcttacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcagatcacagcaggcagacatggggacgacctgcgcaacaccaagcaggagattgctgagatcaaccgcatgatccagaggctgagatctgagatcgaccacgtcaagaagcagtgtgccaacctacaggccgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggatgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactgaagtgctgccgccagctctcagtcccacagctctcaggcccctctctggcagcagagccctctcctcaggttgcttgtcctcccctggcctccagtctcccctgccctcccgggtagagctgggatgccctcacttttcttctcatcaatacctgttccactgagctcctgttgcttaccatcaagtcaacagttatcagcactcagacatgcgaatgtcctttttagttcccgtattattacaggtatctgagtctgccataattctgagaagaaaatgacctatatccccataagaactgaaactcagtctaggtccagctgcagatgaggagtcctctctttaattgctaaccatcctgcccattatagctacactcaggagttctcatctgacaagtcagttgtcctgatcttctcttgcagtgtccctgaatggcaagtgatgtaccttctgatgcagtctgcattcctgcactgctttctctgctctctttgccttcttttgttctgttgaataaagcatattgagaatgtgaa

SEQ ID NO: 145473 - DNA, 2289 bp, Homo sapiens
  Payload ID: 8773
  Gene Symbol: KRT6C
  Gene Name: keratin 6C, type II
  Uniprot ID: P48668
  ENST ID: ENST00000252250
  CDS Start-End: 49-1743
cgcctccagcctccaacgctcgccacagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacagcatcgtcggggaacggggccgcctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactctcacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatacgaggagattgctcagaggagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccatgtcaagaagcagtgtgccagcctgcaggctgccattgctgatgctgagcagcgtggggagatggcactcaaggatgctaagaacaagctggaagggctggaggatgccctgcagaaggccaagcaggacctggcccggctgctgaaggagtaccaggagctgatgaatgtcaagctggccctggatgtggagatcgccacctaccgcaagctgctggagggcgaggagtgcaggctgaatggcgaaggcgttggacaagtcaacgtctctgtagtacagtccaccatctccagtggctatggcggtgccagcggtgtcggcagtggcttaggcctgggtggaggaagcagctactcctatggcagtggtcttggcattggaggtggcttcagttccagcagtggcagagccattgggggtggcctcagctctgttggaggcggcagttccaccatcaagtacaccaccacctcctcctccagcaggaagagctacaagcactaaagtgctgcctccagctctcggtcccacagtcctcaggcccttctctggctgcagagccgtctcctcaggttgcctatcctctcctggcctctagtcttccctgctctccgaggtagagctgggtatggatgcttagtgccctcacttctctctgtctatacctgccccatctgagcacccattgctcaccatcagatcaacctttgattttacatcataatgtattcaccaatggagcttcactttgttactaaattattaatttcttgcctccaaaattgttctctctgaggctgagcattataagaaaatgatctctgttccttttcattactgaaaatcgcctggggcttatttcagaacaacttccacttattttccattggcccccaaactccctaagttaaaagtattgtgaacccccgccccgcagtatgcatggaagcacaagtgactagtcgtatgatgtacacagtctttctccctgtgatgatttctctgctctttgctctttgtaatttctaaataaagcaggttttagaataa

SEQ ID NO: 145474 - DNA, 1754 bp, Homo sapiens
  Payload ID: 8774
  Gene Symbol: KRT7
  Gene Name: keratin 7, type II
  Uniprot ID: P08729
  ENST ID: ENST00000331817
  CDS Start-End: 184-1593
agagggcggagggcggccccaggaggggcctggcagcagagaaaggtggcccgcggcagccccgcccctacctgtggaagcccagccgcccgctcccgcggataaaaggcgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcggggcaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 145475 - DNA, 2265 bp, Homo sapiens
  Payload ID: 8775
  Gene Symbol: KRT71
  Gene Name: keratin 71, type II
  Uniprot ID: Q3SY84
  ENST ID: ENST00000267119
  CDS Start-End: 71-1642
acaaccagcagaaccttttgggattttgccttcctccctcctgcatctgagctttgtctccaccagcaacatgagccgccaattcacctgcaagtcgggagctgccgccaaggggggcttcagtggctgctcagctgtgctctcagggggcagctcatcctccttccgggcagggagcaaagggctcagtgggggctttggcagccggagcctctacagcctggggggtgtccggagcctcaatgtggccagtggcagcgggaagagtggaggctatggatttggccggggccgggccagtggctttgctggaagcatgtttggcagtgtggccctggggcctgtgtgcccaactgtatgcccacctggaggcatccaccaggttaccgtcaatgagagcctcctggcccccctcaacgtggagctggaccccgagatccagaaagtgcgtgcccaggagcgagagcagatcaaggctctgaacaacaagttcgcctccttcatcgacaaggtgcggttcctggagcagcagaaccaggtactggagaccaagtgggagctgctgcagcagctggacctgaacaactgcaagaacaacctggagcccatcctcgagggctacatcagcaacctgcggaagcagctggagacgctgtctggggacagggtgaggctggactcggagctgaggaatgtgcgggacgtagtggaggactacaagaagaggtatgaggaggaaatcaacaagcggacagcagcagagaacgagtttgtgctgctcaagaaggatgtggatgctgcttacgccaataaggtggaactgcaggccaaggtggaatccatggaccaggagatcaagttcttcaggtgtctctttgaagccgagatcactcagatccagtcccacatcagtgacatgtctgtcatcctgtccatggacaacaaccggaacctagacctggacagcatcattgacgaagtccgcacccagtatgaggagattgccttgaagagtaaggccgaggctgaggccctgtaccagaccaagttccaagagcttcagctggcagctggcaggcatggggacgacctcaaaaacaccaagaatgaaatctcggagctcactcggctcatccagagaatccgctcagagatcgagaacgtgaagaagcaggcttccaacctggagacagccatcgctgatgctgagcagcggggagacaacgccctgaaggatgcccgggccaagctggacgagctggagggcgccctgcaccaggccaaggaggagctggcgcggatgctgcgcgagtaccaggagctcatgagcctgaagctggccctggacatggagatcgccacctatcgcaagctactggagagcgaggagtgcaggatgtcaggagaatttccctcccctgtcagcatctccatcatcagcagcaccagtggcggcagtgtctatggcttccggcccagcatggtcagcggtggctatgtggccaacagcagcaactgcatctctggagtgtgcagcgtgagaggcggggagggcaggagccggggcagtgccaacgattacaaagacaccctagggaagggttccagcctgagtgcaccctccaagaaaaccagtcggtagagaagactgccccgggccccgcctcattccatgacccggctctggatcccacactgtacttcccacagcccactctcagctccatctccaccctgctggtcctgctcccatacacctggcactggccttggccacccacttctcccagcctgtgtcttcctgatcctgggaaggcctggatgaccaagcttggtgaaattcctccctgtacacaccctattaactccttggctgtggtcccccagctacaccaccagcccaggtcctggctgccagctttcctcctctgcccggcctctagcgcagtcgctaactactctgctgggctccctgggtctctgcccaaggccccgcacacactgggacctagcatagttcctgcctatgccaggagctggctctgtgtttaagaaaaggaggactgaaggacaaacaaccaagagtggcccagtccccacccccacatctagctcagtctcaaatctgagtgggaccaagtgcaattcagggcctttttctccactcacctgcacccagaagcagagaaaagcaggcactgttcacttttcctttattcttaatggccttcctctgttgcaacctcaataaacagcacaatctca

SEQ ID NO: 145476 - DNA, 2015 bp, Homo sapiens
  Payload ID: 8776
  Gene Symbol: KRT72
  Gene Name: keratin 72, type II
  Uniprot ID: Q14CN4
  ENST ID: ENST00000293745
  CDS Start-End: 87-1622
atttaaggggcgagctgggccgagaacgcagcggctgtttgcgccccttctgcctcccgcgcggccagcaccggtacttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgagcagaaggcttcccaactcacccgtctcctccctctccttccctgggctccctttccaagtcaagaaatgctttgtctgtcactacagtcccaaccccatttcctctccctgttgtcctcaaggtgtgatgcttcgatgcaaggagtccagtcaggagctctctcagtggcctccttcttggtcccgtttcgttgggtcattgcctgaaatgcaaagacaacacttacccaggatgtttccccaaggccagctacaagcccctctgcccccatgcctttcttgggccttcactaccaagggactctcttcatcttctgattgggattgtgtccagtcctctgcttcttctgcaataaatgattaaatctg

SEQ ID NO: 145477 - DNA, 1764 bp, Homo sapiens
  Payload ID: 8776
  Gene Symbol: KRT72
  Gene Name: keratin 72, type II
  Uniprot ID: Q14CN4
  ENST ID: ENST00000354310
  CDS Start-End: 87-1496
atttaaggggcgagctgggccgagaacgcagcggctgtttgcgccccttctgcctcccgcgcggccagcaccggtacttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgagcagaaggcttcccaactcacccgtctcctccctctccttccctgggctccctttccaagtcaagaaatgctttgtctgtcactacagtcccaaccccatttcctctccctgttgtcctcaaggtgtgatgcttcgatgcaaggagtccagtcaggagctctctcagtggcctccttcttggtcccgtttcgttgggtcattgcctgaaatgcaaagacaacacttacccaggatgtttccccaa

SEQ ID NO: 145478 - DNA, 1813 bp, Homo sapiens
  Payload ID: 8776
  Gene Symbol: KRT72
  Gene Name: keratin 72, type II
  Uniprot ID: Q14CN4
  ENST ID: ENST00000537672
  CDS Start-End: 12-1547
acttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgtgatgcttcgatgcaaggagtccagtcaggagctctctcagtggcctccttcttggtcccgtttcgttgggtcattgcctgaaatgcaaagacaacacttacccaggatgtttccccaaggccagctacaagcccctctgcccccatgcctttcttgggccttcactaccaagggactctcttcatcttctgattgggattgtgtccagtcctctgcttcttctgcaataaatgattaaatctg

SEQ ID NO: 145479 - DNA, 1679 bp, Homo sapiens
  Payload ID: 8776
  Gene Symbol: KRT72
  Gene Name: keratin 72, type II
  ENST ID: ENST00000550829
  CDS Start-End: 1-430
tttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaagaaaacaccagcatttatagcatgagaagctacctctgtctcatgaaaactcactgaggcagaggcagatggtaccattgcttaagccctcttcctgattccatatagaccgggtcctatttcttgtcttggagatccaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgag

SEQ ID NO: 145480 - DNA, 574 bp, Homo sapiens
  Payload ID: 8776
  Gene Symbol: KRT72
  Gene Name: keratin 72, type II
  ENST ID: ENST00000549979
  CDS Start-End: 1-574
gcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaagaccgggtcctatttcttgtcttggagatccaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtg

SEQ ID NO: 145481 - DNA, 2284 bp, Homo sapiens
  Payload ID: 8777
  Gene Symbol: KRT73
  Gene Name: keratin 73, type II
  Uniprot ID: Q86Y46
  ENST ID: ENST00000305748
  CDS Start-End: 36-1658
tcagcatcttatccccactttctggcctccccaccatgagccgccaattcacctacaagtcgggagctgctgccaaggggggcttcagcggctgctccgctgtgctctcagggggcagctcatcctcctaccgagcagggggcaaagggctcagtggaggcttcagcagtcggagcctttacagcctggggggtgcccggagcatctctttcaatgtggccagtggcagtgggtgggcaggaggctatggatttggccggggccgggccagtggctttgctggcagcatgtttggcagtgtggccttggggtccgtgtgtccgtcgttgtgcccgcccgggggtatccatcaggtcaccatcaacaagagcctcctggcacccctgaacgtggagctggaccctgaaatccagaaagtgcgtgcccaggagcgggagcagatcaaggtgctgaacaacaagttcgcctccttcattgacaaggtgcggttcctggagcagcagaaccaggtgctggagaccaagtgggagctgctacagcagctggacctgaacaactgcaagaataacctggagcccatccttgagggctacatcagcaacctgcggaagcagctggagacgctgtctggggacagggtgaggctggactcggagctgaggagcgtgcgcgaagtggtggaggactacaagaagaggtatgaagaagaaataaacaagcgcacaactgctgagaatgaatttgtggtgcttaagaaggacgtggacgcagcttacacgagcaaagtggagctgcaggccaaggtggatgccctggatggagaaatcaagttcttcaagtgtctgtacgagggggagactgctcagatccagtcccacatcagcgacacgtccatcatcctgtccatggacaacaaccggaacctggacctggacagcatcattgctgaggtccgtgcccagtatgaggagatcgcccggaagagcaaggccgaggccgaggccctgtaccagaccaagttccaggagctgcagctagcagccggccggcatggggatgacctgaaacacaccaaaaatgagatctcagagctgacccgtctcatccaaagactgcgctcggagattgagagtgtgaagaagcagtgtgccaacctggagacggccatcgctgacgccgagcagcggggggactgtgccctcaaggatgccagggccaagctggatgagctggagggcgccctgcagcaggccaaggaggagctggcacggatgctgcgcgagtaccaagagcttttgagcgtgaagctgtccctggatattgagatcgccacctaccgcaagctgctggagggcgaggagtgcaggatgtccggagaatataccaactccgtgagcatttcggtcatcaacagctccatggccgggatggcaggcacaggggctggctttggattcagcaatgctggcacctacggctactggcccagctctgtcagcgggggctacagcatgctgcctgggggctgtgtcactggcagtgggaactgtagcccccgtggggaagccaggaccaggctggggagtgcaagtgaattcagggactcccagggaaagaccttagctctaagctcacccaccaaaaaaaccatgagataaaagtgcaacacagcccatttcccagtagtctgccttgccctggcagactgctccggactcttctaggaaattcctctgtctcatttgtcctcatctccttcttgctttgctttgctgtggacctctcctccttctccttgacctctctgcctcagtctttgttaatgttgaatcaggatttgagagctggagcccatctttctgcctccatccaaagaggccttttaactcagcctccccttctggaagaagacttggccttttctctgcctgcatgtccctgtgcagaggaaggctgtctctcaagggtaaccccaatctgcctgtgctgctctttcataccctgtctcagtaactatttggccatgtgctccctgggtacacaagttttcagatctactgatagacctgcaggaactctctcatgttagagcaatactggctcaggcaaaacacctggtgggaagttgtatcttgtatagccactgcatattacatagccaggagtaccccttgaggctaattctaccaaccaagggatttgtgctcttcatctgtgggtacttgtccttgtttaggcctcacctccctgctcctgtgtcttaccaataaacttataaagccca

SEQ ID NO: 145482 - DNA, 917 bp, Homo sapiens
  Payload ID: 8777
  Gene Symbol: KRT73
  Gene Name: keratin 73, type II
  ENST ID: ENST00000552855
  CDS Start-End: 1-858
gaagaaataaacaagcgcacaactgctgagaatgaatttgtggtgcttaagaaggagactgctcagatccagtcccacatcagcgacacgtccatcatcctgtccatggacaacaaccggaacctggacctggacagcatcattgctgaggtccgtgcccagtatgaggagatcgcccggaagagcaaggccgaggccgaggccctgtaccagaccaagttccaggagctgcagctagcagccggccggcatggggatgacctgaaacacaccaaaaatgagatctcagagctgacccgtctcatccaaagactgcgctcggagattgagagtgtgaagaagcagtgtgccaacctggagacggccatcgctgacgccgagcagcggggggactgtgccctcaaggatgccagggccaagctggatgagctggagggcgccctgcagcaggccaaggaggagctggcacggatgctgcgcgagtaccaagagcttttgagcgtgaagctgtccctggatattgagatcgccacctaccgcaagctgctggagggcgaggagtgcaggatgtccggagaatataccaactccgtgagcatttcggtcatcaacagctccatggccgggatggcaggcacaggggctggctttggattcagcaatgctggcacctacggctactggcccagctctgtcagcgggggctacagcatgctgcctgggggctgtgtcactggcagtgggaactgtagcccccgtggggaagccaggaccaggctggggagtgcaagtgaattcagggactcccagggaaagaccttagctctaagctcacccaccaaaaaaaccatgagataaaagtgcaacacagcccatttcccagtagtctgccttgccctggcagactgctccggact

SEQ ID NO: 145483 - DNA, 2788 bp, Homo sapiens
  Payload ID: 8778
  Gene Symbol: KRT74
  Gene Name: keratin 74, type II
  Uniprot ID: Q7RTS7
  ENST ID: ENST00000305620
  CDS Start-End: 49-1638
ccttggagactgcttttctccagctctgtcaactcaacctttcccaccatgagtcggcaactgaacatcaagtccagtggtgacaagggcaacttcagtgtgcattcggcagtggtgccaaggaaggctgtgggtagcctggcttcttactgtgcagctggcagaggggctggcgctggctttggcagtcggagcctctatagccttggagggaatcggcgtatttctttcaatgtggctggtggcggcgttcgggctggaggttacggcttcaggcctggctctgggtatggagggggccgggccagtggctttgctggcagtatgtttggcagtgtggccctggggcctgcatgtttgtctgtgtgcccacctgggggcatccaccaggtcactgtcaacaagagcctcttggcccccctcaacgtggagctggaccctgagatccagaaggtgcgcgcccaggagcgggaacagatcaaggtgctgaacgacaagttcgcctccttcattgacaaggtacgcttcctagagcagcagaaccaggttctagaaaccaagtgggagctgctgcagcagctggacctgaacaactgcaagaagaacctggagcccatccttgagggctacatcagcaacctgcggaagcagctggagacactgtctggggacagggtgaggctggactcggagctgagaagcatgagggatctggtggaggactataagaagagatatgaagtggagattaaccggcgcacgacagcagagaatgagtttgtggtgcttaagaaggatgcagatgcagcctacgcagtcaaggtggagcttcaggccaaagtggactcactggacaaagaaatcaagttcctcaagtgtctgtatgatgcagagatcgctcagatccagactcacgccagtgagacctctgtcatcctgtccatggacaacaaccgggacctggaccttgacagcatcatcgctgaggtccgcatgcattatgaggagatcgccctgaagagcaaggccgaggccgaggccctgtaccagaccaagatccaggagctgcagctggcagccagtcggcatggtgacgacctgaaacacaccaggagcgagatggtggagctgaaccggctcatccagaggatccggtgtgagatcgggaatgtgaagaagcagcgtgccagcctggagacggccatcgctgacgctgagcagcggggagacaatgccctgaaggatgcccaggccaagctggatgagctggagggcgccctgcaccaggccaaggaggagctggcgcggatgctgcgcgagtaccaggagctcatgagcctgaaactggccctggacatggagattgccacctaccgcaagctgctggagggcgaggagtgcaggatgtctggtgagaatccatcctctgtgagcatctctgtcatcagcagtagcagctacagctaccaccaccccagctctgcgggtgttgaccttggggccagcgctgtggcaggcagctctggcagcacccagagcgggcagaccaagaccacagaggcgcgagggggagacctcaaggacacccagggcaagagcaccccagccagcatcccagcaaggaaagccacccgctagacccatggcctcacccacctcagcacttggaagaagaggtgactttgccacccccaaaggtgtctgccacacccaagttcccaggccctgagttttaaaactgtctgtagtacactcaactgtctgcatcgtggtttagcttttactttcaagctctgattgacacagtcaccttccctgtttccttaggtcccatgtggactaacgacttctcattttcctcgctgcctttggctggcaggaggctttggaggcacaagccattataaccttcttggccctaaggaagctgtgatcatccctagaaagagggaaggagcaggagacgacaggggaggggctggtttgttctgtgcttaggccaagttagctactgtctgagaggttttacatcccctgccagcatggtggggtgacacgagacctgtaagcaggtggtgagaagttagacagcctttacttgctccatcagaaacaactttgcaggatgacgccaatatttaggacaccacgtgtacatctgtagaccaccagctgcacccatctccacaaagccaagtgaaggtgtattggggattctctgccagcctgtgtcacccacccacctccttcattatcagcaatagctaccatcatttgtcaagcacctactagatgccagacaccctacacatattgcctcctgttctcatccattcctgcaaagaagatgcaatgagcatccttggaacagactgggagcctgatcccaagaggctgctgaactggccccagtcacccacctatgtgccagagtcaggcctggccgacacaaggatctatgctttttctgtggtgtgtcactgcctttttaacaaaagggctgtcaaagtcaccattctttttgatgagggcagcgtaattacattgccttttgtcaggactgtgggtatgtgatttgtcttccacagtctctctggggctgtgtcctacatagcttctgactctcaatttttggtgccatgagctgagctcagtgagtggagctggcttttctgtcgctgagtgctactgcctagtccagatgtcgtggctcagggtgtaaatattcctaagaatggcagcatctatttcctcttttgtttgaattaaagactctgaatttctgctg

SEQ ID NO: 145484 - DNA, 2858 bp, Homo sapiens
  Payload ID: 8778
  Gene Symbol: KRT74
  Gene Name: keratin 74, type II
  ENST ID: ENST00000549343
  CDS Start-End: 40-1671
ctgcttttctccagctctgtcaactcaacctttcccaccatgagtcggcaactgaacatcaagtccagtggtgacaagggcaacttcagtgtgcattcggcagtggtgccaaggaaggctgtgggtagcctggcttcttactgtgcagctggcagaggggctggcgctggctttggcagtcggagcctctatagccttggagggaatcggcgtatttctttcaatgtggctggtggcggcgttcgggctggaggttacggcttcaggcctggctctgggtatggagggggccgggccagtggctttgctggcagtatgtttggcagtgtggccctggggcctgcatgtttgtctgtgtgcccacctgggggcatccaccaggtcactgtcaacaagagcctcttggcccccctcaacgtggagctggaccctgagatccagaaggtgcgcgcccaggagcgggaacagatcaaggtgctgaacgacaagttcgcctccttcattgacaaggtacgcttcctagagcagcagaaccaggttctagaaaccaagtgggagctgctgcagcagctggacctgaacaactgcaagaagaacctggagcccatccttgagggctacatcagcaacctgcggaagcagctggagacactgtctggggacagggtgaggctggactcggagctgagaagcatgagggatctggtggaggactataagaagagatatgaagtggagattaaccggcgcacgacagcagagaatgagtttgtggtgcttaagaaggatgcagatgcagcctacgcagtcaaggtggagcttcaggccaaagtggactcactggacaaagaaatcaagttcctcaagtgtctgtatgatgcagagatcgctcagatccagactcacgccagtgagacctctgtcatcctgtccatggacaacaaccgggacctggaccttgacagcatcatcgctgaggtccgcatgcattatgaggagatcgccctgaagagcaaggccgaggccgaggccctgtaccagaccaagatccaggagctgcagctggcagccagtcggcatggtgacgacctgaaacacaccaggagcgagatggtggagctgaaccggctcatccagaggatccggtgtgagatcgggaatgtgaagaagcagattttttctgtgtccaatgaacctgccccatgtcccctttggcgtgccagcctggagacggccatcgctgacgctgagcagcggggagacaatgccctgaaggatgcccaggccaagctggatgagctggagggcgccctgcaccaggccaaggaggagctggcgcggatgctgcgcgagtaccaggagctcatgagcctgaaactggccctggacatggagattgccacctaccgcaagctgctggagggcgaggagtgcaggatgtctggtgagaatccatcctctgtgagcatctctgtcatcagcagtagcagctacagctaccaccaccccagctctgcgggtgttgaccttggggccagcgctgtggcaggcagctctggcagcacccagagcgggcagaccaagaccacagaggcgcgagggggagacctcaaggacacccagggcaagagcaccccagccagcatcccagcaaggaaagccacccgctagacccatggcctcacccacctcagcacttggaagaagaggtgactttgccacccccaaaggtgtctgccacacccaagttcccaggccctgagttttaaaactgtctgtagtacactcaactgtctgcatcgtggtttagcttttactttcaagctctgattgacacagtcaccttccctgtttccttaggtcccatgtggactaacgacttctcattttcctcgctgcctttggctggcaggaggctttggaggcacaagccattataaccttcttggccctaaggaagctgtgatcatccctagaaagagggaaggagcaggagacgacaggggaggggctggtttgttctgtgcttaggccaagttagctactgtctgagaggttttacatcccctgccagcatggtggggtgacacgagacctgtaagcaggtggtgagaagttagacagcctttacttgctccatcagaaacaactttgcaggatgacgccaatatttaggacaccacgtgtacatctgtagaccaccagctgcacccatctccacaaagccaagtgaaggtgtattggggattctctgccagcctgtgtcacccacccacctccttcattatcagcaatagctaccatcatttgtcaagcacctactagatgccagacaccctacacatattgcctcctgttctcatccattcctgcaaagaagatgcaatgagcatccttggaacagactgggagcctgatcccaagaggctgctgaactggccccagtcacccacctatgtgccagagtcaggcctggccgacacaaggatctatgctttttctgtggtgtgtcactgcctttttaacaaaagggctgtcaaagtcaccattctttttgatgagggcagcgtaattacattgccttttgtcaggactgtgggtatgtgatttgtcttccacagtctctctggggctgtgtcctacatagcttctgactctcaatttttggtgccatgagctgagctcagtgagtggagctggcttttctgtcgctgagtgctactgcctagtccagatgtcgtggctcagggtgtaaatattcctaagaatggcagcatctatttcctcttttgtttgaattaaagactctgaatttctgctgtatattcattaagttgtccttgagtgttgtcagaggt

SEQ ID NO: 145485 - DNA, 2324 bp, Homo sapiens
  Payload ID: 8779
  Gene Symbol: KRT75
  Gene Name: keratin 75, type II
  Uniprot ID: O95678
  ENST ID: ENST00000252245
  CDS Start-End: 222-1877
agccagtggcccttacaccatttcccgagggatgccgagtgtgagctcagggttggcggatgcccagggaatgccatcagaaggccctctccactagcagtgccccgcccccacaggatgctcataaaagccacgagaccagggctctccagccacctgtcttctccactgcctgtaccagcccacctcaggtgccttctcgccggccttcctcacccaccatgtctcggcagtcctccatcaccttccagtctggcagccgcaggggcttcagcaccacctcggccatcaccccggcagctggccgctcccgcttcagctctgtctctgtggcccgctctgcagcagggagtgggggcctgggaaggatcagcagtgctggggccagctttggaagccgcagcctctacaacctggggggtgccaagcgggtctccatcaatgggtgtggcagcagctgccgaagtggctttggtggcagggccagcaacaggtttggagtcaacagtggatttggctatgggggtggagttggaggaggcttcagtggccccagcttccccgtgtgtccccctggaggcatccaagaggtcactgtcaaccagagtctcctgactcctcttcacctgcaaatcgaccccaccatccagcgggtgcgggccgaggagcgcgagcagatcaagaccctcaacaataagttcgcctccttcatcgacaaggtgaggttcttggagcagcagaacaaggtcctggagaccaagtgggccctcctgcaggagcagggctccaggactgtgaggcagaacctagagcccctctttgattcctataccagtgagctccgacggcagctggaaagcatcaccaccgagaggggcaggcttgaagctgaactgaggaacatgcaggatgttgtggaagatttcaaagtcaggtacgaagatgaaattaacaagcgcacagctgctgagaatgaatttgtagccctgaaaaaggacgtagatgctgcctatatgaacaaggtggagctggaagccaaggtcaaatctctgcccgaggagatcaacttcatccactcagtctttgatgcagagctgtcccagttgcagacccaggtcggtgacacatccgtggtgctgtccatggacaacaaccgcaacctggacctggatagtatcatcgccgaggtcaaagcacaatacgaggacattgccaaccgcagccgggccgaggctgagtcctggtaccagaccaagtacgaggagctgcaggtcaccgcaggcagacatggggatgaccttcgaaacaccaaacaagagatctctgaaatgaaccgcatgatccagaggctgagagctgagattgacagcgtcaagaagcagtgttccagcttgcaaacggccattgctgatgcagagcagcggggagaactggctctcaaggatgcacgggccaagctggtggaccttgaggaggccctgcagaaggccaagcaggacatggctcggctcctgcgtgagtaccaggagctgatgaacatcaagctggccctggacgtggagatcgccacctaccgcaagctgctggaaggcgaggagtgcaggttgagtggagagggagtttctccagttaacatttctgtggtcacctctactctttccagtggctatggaagcggcagcagcattggaggtggaaacctgggcctcggtgggggcagcggctactccttcaccaccagtggtgggcatagcctgggtgcaggcctgggaggttctggattcagtgccaccagcaaccggggcttagggggcagtggttctagcgtcaagtttgtctccaccacatcctccagccagaagagctacacgcactaagagagccccatggctccctctaccctgccttgaggcctgtttgcagtcacacctggacaccagggtcctcctccttcctctctccttgtaaggtgcacctgtgctgctgggagcctggagtactggctatacccattcccaggcctaagccagcctctccctcctgacagtgcccagactgccagcagcacccgtctgttacacatgtgaaaccaaagcctgctctctcctaaggctctcattcagcctatcttgcgaggcccgggcagctggaaagtcctcctccagctccacctccctccctccctccagatgcagaggctggggagtctctcaatgccaggttgtcacccacctgtctcatagtgtttataagtggcctgctgggagtgagtgctccctctgttccctccctggaatgtgtctattaaatgcatgtgtcacctg

SEQ ID NO: 145486 - DNA, 2529 bp, Homo sapiens
  Payload ID: 8780
  Gene Symbol: KRT76
  Gene Name: keratin 76, type II
  Uniprot ID: Q01546
  ENST ID: ENST00000332411
  CDS Start-End: 55-1971
atccctctcagctcttgctaagtgatcactagcttgcctccaagctctctcactatgaacagacaagtttgcaagaaatccttcagtggcaggagccagggtttctctggccgctctgctgtggtctccggcagcagcaggatgagctgtgtggcccgctctgggggagctggtggaggggcctgtggcttcaggagcggagcaggcagctttggcagtcgcagcctctacaacctgggcagcaacaagagcatctccatcagcgtggcagctggcagctcccgggctggaggctttgggggagggcggagcagctgtggctttgcaggtggctatggaggtggctttgggggcagctatggtggtggctttggtggtggcagaggagtaggtagtggttttggaggggctggtggctttggtggagctggtggctttggtggtcctggtgtatttggtgggcctggcagctttggtggtcctggtggctttggccctgggggctttcctgggggaattcaggaagtgattgtaaaccagagtctcctgcagcccctcaatgtggagatcgacccccagattgggcaagtaaaggcccaggagcgggaacagatcaagaccctcaacaacaagtttgcctccttcatcgacaaggtgcggttcctggaacagcagaacaaggtcctggagaccaagtgggaactgctccagcagcagaccacaggctcagggcccagcagcctggagccttgttttgaatcctacatcagcttcctatgcaagcagctagattcacttctaggggagagggggaacctggagggagagctgaaaagcatgcaggacctggtggaagacttcaaaaagaagtatgaagatgaaatcaacaaacgcactgccgcagagaatgagtttgtggggctcaagaaggatgtggatgcggctttcatgaacaaggtggagctgcaggccaaagtggacagcctgacagatgaagtcagcttcctgaggaccctctatgagatggagctgtcccagatgcaaagccatgccagtgacacgtctgtggttctgtccatggacaacaaccgctgcctggacctgggcagcatcattgccgaggtccgcgcccagtatgaggagattgcccagaggagcaagtctgaagctgaggccctgtaccagaccaagcttggggagctgcagaccacagctggcaggcatggggatgacctgaggaacaccaagagtgagatcatggagctcaacaggatgatccagaggctacgggctgagattgaaaatgtcaagaagcagaatgccaacctgcagacggcaattgcagaggctgagcagcgtggagagatggccctcaaggacgccaatgccaagctccaagacttgcagactgccctacagaaggctaaggatgacctggctcggctcctgcgtgactaccaggagctgatgaacgtcaagctggccctggatgtggagattgccacctaccgcaagctgctggagggagaggagtgcaggatgtctggagaatgtcagagtgccgtgtgcatttcagtggtcagcaatgtcaccagcacaagtggcagctctggcagtagccgtggagtttttggaggggtcagtggcagtggcagtggtggctacaaaggcggcagcagcagcagcagcagcagtggctatggagtcagtggcggcagcggcagtggctatggaggggtcagcagtggcagcactgggggcaggggtagcagcgggagctaccagagcagcagtagtgggagcaggctcggcggtgcaggtagcatctccgtgagccacagtggaatgggctccagctctggcagcatccagacttctggaggaagtggctacaagtctggtggtggaggcagcaccagtatccgcttctcccagaccacgagctcaagccagcatagctccaccaagtgatctactgttccaaatctctataaccacctgcttcccactcagcctgcaatagtgtttcccactctctgcttggcatcaatagatgcataagggtcaaccacatttttcctcaagttccctggagaagaagctgaactcctggtttctccatccccatgaccttcccagggccatggaggtcctgctgctggtctgggatgatgatgcccctggaaaccttcctgcaatggccccttactttggacagcaacccctgagcccaagccagttttggccttcacagcctggcctgttcccactctggcccatctccctttcttactgggagttggagatttgaagccagtcatctcagcactgtctgaggagggcagagccatgggttctgtgctggagggtgcacggccaagatctccagactgctggttcccagggaaccctccctacatctgggcttcagatcctgactcccttctgtcccctaattccctgagctgtagatcctctggtgatgagtatgttgcactttcttttctcaataaattgcactgaacttca

SEQ ID NO: 145487 - DNA, 3305 bp, Homo sapiens
  Payload ID: 8781
  Gene Symbol: KRT77
  Gene Name: keratin 77, type II
  Uniprot ID: Q7Z794
  ENST ID: ENST00000341809
  CDS Start-End: 30-1766
tgcctgcttctctggatgctccagcaaacatgagccaccaatttagttctcagtccgcgtttagttcaatgagcaggcgggtttatagtaccagctcttctgcaggctctggtggtgggagtccggcagtgggttctgtgtgttatgctcgagggaggtgtggtggtggtggatatgggatccatggaagggggtttggctctaggagcctctacaatctgggtggcagtagaagcatctccattaatctaatggggaggagcaccagtggtttctgccagggtgggggagtagggggatttggagggggcagaggctttggggttggcagcaccggggctggtggctttggaggaggtggttttgggggtgctggatttgggactagcaattttgggcttgggggctttggtccttattgtcctcctgggggcatccaagaggtgaccattaaccagagcctcctagagccacttcacctggaggtggaccctgaaattcagaggatcaagacccaggagcgggagcagattatggttctcaacaacaagtttgcctccttcattgacaaggtgcgattcctggagcagcagaaccaggtgctacaaacaaaatgggagttgctgcagcaggtgaacacctcaactggaaccaacaacctggagcccctcttggagaactacatcggtgacctgcggaggcaggtggatttgctcagtgcggagcagatgcgccagaacgcggaggtcaggagcatgcaggatgtcgtggaggactacaagagcaagtatgaggatgaaatcaacaagaggactggcagcgagaatgactttgtcgtcctgaagaaggatgtggatgctgcttatgtgagcaaagtggacctggagtccagggtggacactctgactggggaggtcaatttcttgaaatatttatttttgacggagctgtctcaggtgcagactcacatcagcgacaccaacgtcatcctgtccatggacaataaccgttccctggacctggacagcatcatcgatgcagtgcggacccagtatgaactgattgcacagaggagcaaggacgaggccgaagccctgtaccagaccaagtaccaggagctccagatcacggcagggagacatggagacgacctgaagaacagcaagatggagattgcagagctcaaccgcaccgtccagaggctgcaggcagagatcagcaacgtgaagaagcagattgaacagatgcagtcactcatttcggatgctgaggagagaggcgagcaggccctccaggatgcgtggcagaagctgcaggacctggaggaggccctgcagcagtccaaggaggagctggcccggctgctgcgtgactaccaggccatgctgggggtcaagctgtccctggatgtggagatcgccacctaccgccagctgctggagggcgaggagagcaggatgtcaggagagctgcagagccatgtgagcatctccgtgcagaacagccaggtgagcgtcaacggcggcgcgggaggcggcggcagctacggctcaggaggctacggcggcggcagcggtgggggctatggcggcggaagaagctaccgcggaggcggggcacgaggcaggagtggaggcggttatggcagcggctgcggcggcggtggcgggagctacggagggagcggcagaagcggccgcggatcctcgcgcgtgcagatcatccagacctccaccaacacctcccacaggcggatcttggagtagaggcctcgtttctgccacacatcacgcctgcccctcaccgccctctcctcaaactcctcccctccacgcccttcctgatcccctctcattcacttttcttaatgggtctcagcaattttgccaataaattcgactctaatgggggaagcagggtggataagtccaaacagcagatctctctttggagggcactggcttgcagtcagattcacagctaggcacattctcactcagaccccgctctgctggccctgctgctgttcctgctcccacctttttggaagatcggtagcccagggtgagcacaaacattccagttagaggcagaggctgcgtgagttggcaaggtagggagaagtcattgttatcattcctctgcctccaagtagaatgcccttatgccccagttcaagccactgcagctaagtattaatccccagtgctaaaagataccaggcatctagtttagcaatggagggaaacagaaacagcctgtagagagcatcgacaaggcgcataatggagagttggtatctcaaccccaagctccctttgctgtacctgggctgctctgtgaacaagaatccacgcccccctgccctgctggggaccacataatgatccctttgggggaagttgctgattgcagggcaagctagcttggtaaggaaaacctctgcaccagcggcctattcctgcctcttggtccatagcctcatacactcatgttgatggatagtatagatttgctgcccacaccagatatctgtaaggcatcactgtcctgattctgaacctctgtttcaggaagcattctcccctgtgtaaacaactcaaggtggaagtatttcagagggcatagggtcatgaatccttacccaaaggaagcctgttttagcagtggatgcaggagttgatgaacagacaagcaagttctgcttctgtcctgtttcctcctgacagctccattcttttgaagcctgacccttcctaagctctgcatcataaccactctgagaattgccccattgggtgggcatgtgaagcccagctctgttccatccaggtgcctcgggcctgaggagtctgaggatctgacttgggtcttggaagggttccaaccccaagtcagtcaggaagctgcccatttttttgcaaggcattttaatgccctttcccagacctctctagtccctcctgccttctgttctctgtagctgtgagccctttgtgagaatatgactcttaattttgaatcttatgtaagaggcttgagatgtgctggagagggcaggaagaggaaagtatcaggccttgagagagggaatgtagctttgcttctatgatctggagtcaccttcacttgctagctgagtcctaacacaacttccaagtccatgattctcttggggcattggatgggctcagtgtgggtctcttaggctgttcttgtgacttcatcatttcctggttcaaagttgtactgtcaaggggcagcatttctggtatttctataataaatttttctgtgatctcaaa

SEQ ID NO: 145488 - DNA, 2212 bp, Homo sapiens
  Payload ID: 8781
  Gene Symbol: KRT77
  Gene Name: keratin 77, type II
  ENST ID: ENST00000553168
  CDS Start-End: 30-776
tgcctgcttctctggatgctccagcaaacatgagccaccaatttagttctcagtccgcgtttagttcaatgagcaggcgggtttatagtaccagctcttctgcaggctctggtggtgggagtccggcagtgggttctgtgtgttatgctcgagggaggtgtggtggtggtggatatgggatccatggaagggggtttggctctaggagcctctacaatctgggtggcagtagaagcatctccattaatctaatggggaggagcaccagtggtttctgccagggtgggggagtagggggatttggagggggcagaggctttggggttggcagcaccggggctggtggctttggaggaggtggttttgggggtgctggatttgggactagcaattttgggcttgggggctttggtccttattgtcctcctgggggcatccaagaggtgaccattaaccagagcctcctagagccacttcacctggaggtggaccctgaaattcagaggatcaagacccaggagcgggagcagattatggttctcaacaacaagtttgcctccttcattgacaagagaaaggaaccttggggtcatcagtgtctcagatgctccgaaacaccatttccttacgttggcatggataaattgagtgtggagggtgcgattcctggagcagcagaaccaggtgctacaaacaaaatgggagttgctgcagcaggtgaacacctcaactggaaccaacaacctggagcccctcttggagaactacatcggtgacctgcggaggcaggtggatttgctcagtgcggagcagatgcgccagaacgcggaggtcaggagcatgcaggatgtcgtggaggactacaagagcaagtatgaggatgaaatcaacaagaggactggcagcgagaatgactttgtcgtcctgaagaaggatgtggatgctgcttatgtgagcaaagtggacctggagtccagggtggacactctgactggggaggtcaatttcttgaaatatttatttttgacggagctgtctcaggtgcagactcacatcagcgacaccaacgtcatcctgtccatggacaataaccgttccctggacctggacagcatcatcgatgcagtgcggacccagtatgaactgattgcacagaggagcaaggacgaggccgaagccctgtaccagaccaagtaccaggagctccagatcacggcagggagacatggagacgacctgaagaacagcaagatggagattgcagagctcaaccgcaccgtccagaggctgcaggcagagatcagcaacgtgaagaagcagattgaacagatgcagtcactcatttcggatgctgaggagagaggcgagcaggccctccaggatgcgtggcagaagctgcaggacctggaggaggccctgcagcagtccaaggaggagctggcccggctgctgcgtgactaccaggccatgctgggggtcaagctgtccctggatgtggagatcgccacctaccgccagctgctggagggcgaggagagcaggatgtcaggagagctgcagagccatgtgagcatctccgtgcagaacagccaggtgagcgtcaacggcggcgcgggaggcggcggcagctacggctcaggaggctacggcggcggcagcggtgggggctatggcggcggaagaagctaccgcggaggcggggcacgaggcaggagtggaggcggttatggcagcggctgcggcggcggtggcgggagctacggagggagcggcagaagcggccgcggatcctcgcgcgtgcagatcatccagacctccaccaacacctcccacaggcggatcttggagtagaggcctcgtttctgccacacatcacgcctgcccctcaccgccctctcctcaaactcctcccctccacgcccttcctgatcccctctcattcacttttcttaatgggtctcagcaattttgccaataaattcgactctaatgggggaagcagggtggataagtccaaacagcagatctctctttggagggcactggcttgcagtcagattcacagctaggcacattctcactcagaccccgctctgctggccctgctgctgttcctgctcccacctttttggaagatcggtagcccagggtgagcacaaacattccagttagaggcagaggctgcgtgagttggcaaggtagggagaagtca

SEQ ID NO: 145489 - DNA, 1778 bp, Homo sapiens
  Payload ID: 8782
  Gene Symbol: KRT78
  Gene Name: keratin 78, type II
  Uniprot ID: Q8N1N4
  ENST ID: ENST00000304620
  CDS Start-End: 65-1627
agaaactcacacaccttgacaatctgtctgtccgtctgcagctgcgtgactgtctgtctctgccatgtctctctccccatgccgggcccagaggggcttcagcgctcgctcagcctgttctgctcgctcaaggggccgcagcaggggaggcttcagcagcaggggcggcttcagcagcaggagccttaattcctttggggggtgcctggaaggctctcgtgggagtacctgggggtcagggggtaggctgggggtgcggtttggggagtggagtggtgggcctgggctctccctgtgccctccggggggcatccaagaagtgaccatcaaccagaatctgctgaccccactgaagattgagatcgatccccagttccaggtggtgcggacgcaggagacccaggagatcagaaccctcaacaaccagtttgcttccttcattgacaaggtgcggttcctggagcagcagaacaaggtcctggagacgaagtggcatctgctgcagcaacaggggttgagtggcagccagcagggcctggagcctgtctttgaggcctgcctggatcagctcaggaagcagctggagcagctccagggagaacgaggggctctggatgctgagttgaaggcctgccgggaccaggaggaggagtataagtccaagtatgaggaggaggcccacaggcgtgccacacttgagaacgactttgtggtcctcaagaaggatgtggatggggttttcctgagcaagatggagttggagggcaagctggaggctctgagagagtacctctacttcttgaagcatctgaatgaagaagagctgggccagctccagacccaggccagcgacacgtctgtggtgctgtccatggacaacaaccgctacctggacttcagcagcatcatcactgaggtccgcgcccggtacgaggagatcgcccggagcagcaaggctgaggctgaggccttgtaccagaccaagtaccaggaacttcaggtgtctgcccagcttcatggggacaggatgcaggaaacgaaagtccagatctctcagctacaccaagagattcagaggctgcagagtcagactgagaacctcaagaagcagaacgccagcctgcaggccgccatcactgatgctgagcagcgtggggagctggccctcaaggacgctcaggccaaggtggacgagctggaggctgctctgaggatggccaagcagaacctggcccggctgctgtgcgagtaccaggagctgacgagcacgaagctttccctggatgtggagattgccacttaccgcaggctgctggagggcgaggagtgcaggatgtctggggagtgcaccagccaggtcactatctcctcggtgggaggcagcgctgtcatgtctggaggagttggtggaggcttggggagcacttgtggactcggtagtgggaaaggcagccctgggtcctgctgcaccagcattgtgactggaggctccaacatcattctgggctctgggaaggaccctgttttggattcctgctctgtgtctggctccagcgctggctccagctgccacaccatcctgaagaagacagttgagtcgagtctgaagacatccatcacctactgagcgacccagcagccacctccttcctgaacacatttggcccactccccccatcagccggctctgcaaggccaactccgtgtccgctgcccacagcccaagccagcccacagcggatgctgcaaaaatcaataaagtctcccctcctgctgtt

SEQ ID NO: 145490 - DNA, 2554 bp, Homo sapiens
  Payload ID: 8782
  Gene Symbol: KRT78
  Gene Name: keratin 78, type II
  Uniprot ID: Q8N1N4
  ENST ID: ENST00000359499
  CDS Start-End: 13-1245
gttcagagtgtcatggaaggtcatgaggcttcccctgcccaggttgggcagggggacaggggaaaggtgcggttcctggagcagcagaacaaggtcctggagacgaagtggcatctgctgcagcaacaggggttgagtggcagccagcagggcctggagcctgtctttgaggcctgcctggatcagctcaggaagcagctggagcagctccagggagaacgaggggctctggatgctgagttgaaggcctgccgggaccaggaggaggagtataagtccaagtatgaggaggaggcccacaggcgtgccacacttgagaacgactttgtggtcctcaagaaggatgtggatggggttttcctgagcaagatggagttggagggcaagctggaggctctgagagagtacctctacttcttgaagcatctgaatgaagaagagctgggccagctccagacccaggccagcgacacgtctgtggtgctgtccatggacaacaaccgctacctggacttcagcagcatcatcactgaggtccgcgcccggtacgaggagatcgcccggagcagcaaggctgaggctgaggccttgtaccagaccaagtaccaggaacttcaggtgtctgcccagcttcatggggacaggatgcaggaaacgaaagtccagatctctcagctacaccaagagattcagaggctgcagagtcagactgagaacctcaagaagcagaacgccagcctgcaggccgccatcactgatgctgagcagcgtggggagctggccctcaaggacgctcaggccaaggtggacgagctggaggctgctctgaggatggccaagcagaacctggcccggctgctgtgcgagtaccaggagctgacgagcacgaagctttccctggatgtggagattgccacttaccgcaggctgctggagggcgaggagtgcaggatgtctggggagtgcaccagccaggtcactatctcctcggtgggaggcagcgctgtcatgtctggaggagttggtggaggcttggggagcacttgtggactcggtagtgggaaaggcagccctgggtcctgctgcaccagcattgtgactggaggctccaacatcattctgggctctgggaaggaccctgttttggattcctgctctgtgtctggctccagcgctggctccagctgccacaccatcctgaagaagacagttgagtcgagtctgaagacatccatcacctactgagcgacccagcagccacctccttcctgaacacatttggcccactccccccatcagccggctctgcaaggccaactccgtgtccgctgcccacagcccaagccagcccacagcggatgctgcaaaaatcaataaagtctcccctcctgctgttctgaatgctctaagtgcttgcacacctcacccagcaaaacaaaagctgtgtggctccccagcttcctctcctcggaaggcaattgtggcatatctgtgtccagacgtgttctattggtatctcactccacatcccagccactctatcaagggatccttcaagctctccagtgtgttccttggggtgccctccatctcccacaactccactgatgttttagctgtgcttgtagctcacttcctcatcaactgcctgttttaagaggttctagtcctgactggggcagcccccttccttcttgttcctccttcttcctgactgtgcaccaaaattttctccttttaggaaccttctctaattcccatgtctaaactactgggcccttcctgtccctggcagtctggctgcacctgttgctgtcctgggtgctatgtctgtctggctctggtaagggactcagcttctctattagcctggcactcctgcatccaggatgaggatgtgctcagcttgtgcctgggggctctgatggagattggggttcaaactctgcccctacccccttatctgttggctctcatcttatccttgggcaagtgtgaacatgaggctggaaacttctcctccttcctctccttcaggaagctctgcaggaagccaggagtgtgggaatcaggtggggtgccaggaggggctggaaggatcaccttttctacacacccccagcagcctcatgggtgcctgcagttgctctttccccattctcgctttccagacccaggtgggggacctggctcaaccccaaactccatagtctgggctgcaggaggtcacactacgcctctccttgctttagagggagggcagacctttcctcagattcatgaatcgctccatccaaattatgcaagaaggcttttcagctttgtgtgaaggagaccagagccggtgaggatgtggcttgaatcccagctctgctgtttcctagtggtgtgaccttgatcaagcagcttgacctcttcagttacctcatctgtaaaaagagattaataataatatgtacctcacagggctgtgtggcgacagtgccactaggatcccagaaggaaactaaattcatccaaggtagttcaattaaattgactttttgaaaaagta

SEQ ID NO: 145491 - DNA, 458 bp, Homo sapiens
  Payload ID: 8782
  Gene Symbol: KRT78
  Gene Name: keratin 78, type II
  ENST ID: ENST00000547920
  CDS Start-End: 1-124
ggatgtggagattgccacttaccgcaggctgctggagggcgaggagtgcagcctcggtgggaggcagcgctgtcatgtctggaggagttggtggaggcttggggagcacttgtggactcggtagtgggaaaggcagccctgggtcctgctgcaccagcattgtgactggaggctccaacatcattctgggctctgggaaggaccctgttttggattcctgctctgtgtctggctccagcgctggctccagctgccacaccatcctgaagaagacagttgagtcgagtctgaagacatccatcacctactgagcgacccagcagccacctccttcctgaacacatttggcccactccccccatcagccggctctgcaaggccaactccgtgtccgctgcccacagcccaagccagcccacagcggatgctgcaaaaatcaataaagtctcccctcctgc

SEQ ID NO: 145492 - DNA, 2068 bp, Homo sapiens
  Payload ID: 8783
  Gene Symbol: KRT79
  Gene Name: keratin 79, type II
  Uniprot ID: Q5XKE5
  ENST ID: ENST00000330553
  CDS Start-End: 36-1643
gccctctcatcctgccctccggcccctctgcagctatgaggtcctccgtctctcggcaaacatactccacaaaagggggcttcagctccaactctgccagcggagggagtgggtcccaggcccgcaccagcttcagctcagtgacggtgtctcggagcagtggcagtggtggcggggcccactgtggccccggcacaggtggctttggcagccgaagcctctataacttggggggccacaagagtatctctgtcagtgtggccggaggggccttgttggggcgggctctggggggctttggctttggcagcagggcatttatgggacagggggctggcaggcagacgtttgggcctgcttgtcctcctggggggatccaggaggtcactgtcaaccagagcctgctgacccccctccatgtggagattgaccccgagatccagcgagtgcgcactcaggagcgggagcagatcaagaccctcaacaacaagttcgcctccttcatcgacaaggtgcggttcctggagcaacagaataaggtgctggagaccaagtgggcactgctgcaggagcagggccagaacttgggtgtcaccaggaacaacctggagcccctctttgaggcctacctgggtagcatgcggagcacgctggacagacttcagagcgagcgggggaggctggactcagagctcaggaacgtgcaggaccttgtggaggacttcaagaacaagtacgaggatgaaatcaacaagcacactgctgcagagaacgagtttgtggtgctcaagaaggatgtggatgcagcatacatgggccggatggatctgcatggcaaagtgggcaccttgacccaggagattgacttcctgcagcaactctatgaaatggagctgagccaagtgcagacccacgtgtctaacaccaatgtggtgctgtccatggacaacaaccgcaacctggacctggacagcatcatcgccgaggtcaaggcccagtatgagctgattgcccagaggagccgggctgaggccgaggcctggtaccagaccaagtatgaggagctgcaggtgactgctgggaagcatggggacaacctgcgggacaccaagaacgagattgctgagctcacccgcactatccagaggctgcagggggaggctgatgcagccaagaagcagtgtcagcagctgcagacggccattgcggaagcggagcagcgtggggagctggcactcaaggatgctcagaagaagcttggggatctggatgtggccctgcaccaggccaaggaggacctgacacggctgctgcgtgactaccaggagctgatgaatgtcaagctggccctggacgtggagattgccacctaccgcaagcttctggagagcgaggagagcaggatgtctggagaatgtcccagtgcagtcagcatttctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagaccactacggtcaagacgtccagccagaggtattagctgctgagccctgcaagggcccctgcaatcctgtccctgccctcctcaccccacctctgctgtcctttccagtcacttctcaggagcaggaacagccaggggacctcagacccagggtattttcataccagactatttgcatcttgggaagcgctcaaatctactcaggttttctccttggtcctgcagtaggatgggagggaaggttaaagttgccagcttgagtgatgtgcttgggtgacttgggggtgaccttttgaccaccgagaggaggctgaatttctcaagccattaggagagagagaaattgggagtggtccccaaagacccttcaacctccccagtcccccaccagacccaccctctccctgaatctacccacatcccccttccctgtctgtgtctcaataaatggtgcaactgca

SEQ ID NO: 145493 - DNA, 761 bp, Homo sapiens
  Payload ID: 8783
  Gene Symbol: KRT79
  Gene Name: keratin 79, type II
  ENST ID: ENST00000549255
  CDS Start-End: 1-360
ctgcaccaggccaaggaggacctgacacggctgctgcgtgactaccaggagctgatgaatgtcaagctggccctggacgtggagattgccacctaccgcaagcttctggagagcgaggagagcaggatgtctggagaatgtcccagtgcagtcagcatttgtgagtatttactccccacttcctgctccacccctggccaggccccagaactctgctcagtttatgcaacctgtacctgtcctaaagcatgctctcctccattcgagcccctggagacaggttcagagggtcctagttctgggcttctctatccatttcccatagctctgctgcttgattttgttctgattccccactgatttctgggtctcccccagccctctctggcatggccgccctgactaatccagaccctttgctttgcagctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagaccactacggtcaagacgtccagccagaggtattagctgctgagccctgcaagggcccctgcaatcctgtccctgccctcctcaccccacctctgctgtcctttccagtcacttctcaggagcaggaacagccaggggacctcagacccagggtattttcatac

SEQ ID NO: 145494 - DNA, 1882 bp, Homo sapiens
  Payload ID: 8784
  Gene Symbol: KRT8
  Gene Name: keratin 8, type II
  Uniprot ID: P05787
  ENST ID: ENST00000293308
  CDS Start-End: 197-1648
gacctaaacctcctgccttccacccacagcatgccctgcctggccccacccaggcctggggtgccttgctcagctccccaatctccaacctcccacaggccattcctgagagctctcctcaccaagaagcagcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgc

SEQ ID NO: 145495 - DNA, 918 bp, Homo sapiens
  Payload ID: 8784
  Gene Symbol: KRT8
  Gene Name: keratin 8, type II
  ENST ID: ENST00000548998
  CDS Start-End: 51-918
cctcccatgcctagctgctgctcttagggaccctgtggctaggtgcgcggatggaaatccagtgctcccggattttgctctccagcctccggttctcggtctccaggctcctcactctgtccaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggaca

SEQ ID NO: 145496 - DNA, 1755 bp, Homo sapiens
  Payload ID: 8784
  Gene Symbol: KRT8
  Gene Name: keratin 8, type II
  Uniprot ID: P05787
  ENST ID: ENST00000546897
  CDS Start-End: 157-1608
gtaaagctctcaaccctgtccccttccccctctctcctgggaaagagccctcccatgcctagctgctgctcttagggaccctgtggctaggtgcgcggatggaaatccaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctg

SEQ ID NO: 145497 - DNA, 2126 bp, Homo sapiens
  Payload ID: 8784
  Gene Symbol: KRT8
  Gene Name: keratin 8, type II
  Uniprot ID: P05787
  ENST ID: ENST00000552551
  CDS Start-End: 434-1885
atgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctgtccaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaatgtc

SEQ ID NO: 145498 - DNA, 1165 bp, Homo sapiens
  Payload ID: 8784
  Gene Symbol: KRT8
  Gene Name: keratin 8, type II
  ENST ID: ENST00000546826
  CDS Start-End: 345-1165
gtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccagccctcaggtcctcgatgatcttgaagtaatggctccagtctctgacctggggtcccttcttctccaagtgctcccggattttgctctccagcctccggttctcggtctccaggctcctcactctgtccaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcag

SEQ ID NO: 145499 - DNA, 250 bp, Homo sapiens
  Payload ID: 8784
  Gene Symbol: KRT8
  Gene Name: keratin 8, type II
  ENST ID: ENST00000547176
  CDS Start-End: 1-106
gctggagactctgggccaggagaagctgaagctggaggcggagcttggcaacatgcaggggctggtggaggacttcaagaacaagatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccc

SEQ ID NO: 145500 - DNA, 1687 bp, Homo sapiens
  Payload ID: 8784
  Gene Symbol: KRT8
  Gene Name: keratin 8, type II
  Uniprot ID: P05787
  ENST ID: ENST00000552150
  CDS Start-End: 21-1556
attcagcaaatgtttgcggaatgaatggggtgagctggagccaggacctgcaggaagggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctg

SEQ ID NO: 145501 - DNA, 765 bp, Homo sapiens
  Payload ID: 8784
  Gene Symbol: KRT8
  Gene Name: keratin 8, type II
  ENST ID: ENST00000546542
  CDS Start-End: 226-765
gctcttgggatctatgcatttttctggaagggacttcaatgtgtggggtgtgtgtgtgtgtgtgtgtgtatgcacgcgtgcattgtgaagagagcttgtctgtgtgtctgtctttttaagtttgtctgtcctccaaggagggggcttctgggtctctctgtccttctgggtaggggtcctatgtgcctgtctttctgtgagcctgggtgtctctcctagagaaggatggggaagaaactgtacatctgtcctcccagtaggtggtcacccccttccctgggtcagggctatgtcacctgtccctctcctcaaggggatctggctgtcatctgttggtcctctgagttcagtttcatccagtccccacatcacaccctgcagtatcttccagagaacccagccccagccatcaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagttt

SEQ ID NO: 145502 - DNA, 523 bp, Homo sapiens
  Payload ID: 8784
  Gene Symbol: KRT8
  Gene Name: keratin 8, type II
  ENST ID: ENST00000546900
  CDS Start-End: 185-523
actttcacacagcaggagccaggccgggttttgcagccctgggactccgctgcctgaggggccccgggcccccggcggccccgaggattgggcccttcacgctgactggctcctgggaggcattgtgggaacgggaggagggaaatcctggggcagagtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagag

SEQ ID NO: 145503 - DNA, 2437 bp, Homo sapiens
  Payload ID: 8784
  Gene Symbol: KRT8
  Gene Name: keratin 8, type II
  ENST ID: ENST00000619952
  CDS Start-End: 149-247
tcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccagtgctcccggattttgctctccagcctccggttctcggtctccaggctcctcactctgtccaggtggaggaggtgctggcgagtttgaaatttgggagtcttgaccgggcgcagtggctcacgcctgtaatctcagcactttgggaggcctaggtgggcggatcacgaggtcaggagatcgagaccatcctagccaacatggtgaaaccccctctctactaaaatacaaaaaattagccggacgtgatggtgcacgcctgtagtctcagctacttgggaggctgaggaaggggaatcgcttgaacctgggaggcggaggttgcagtgagccgagatcgcgccactgcagcctggcgacagagtgagactctgtctcaaaaaaaaaaaaaaaaaaaaagaaaaaagaaatttgggggtctggtggtgtgcgggtggaatggcctgtgagtccctctagctgtccttaacctgcagcccaaattatccacttgtggaggggatcttgggggcatcctggagccccaggagtcccggggaagaaaggctgggagctggagaagaggaggagaagcaatgcccagcctcatagctgcttgcttacacactcacaccccagctgcacctggctcccaaacactcctcgcctgcccacgtttcctcacacacactcacacccgaatcatacagaggtgtgctctcaaatgcacacacacatacattcactcagcaaataggtgcagactccccaaaacaaacccagtctctgagccccctccaccaccctcccctctcccgacctcactcccaagggccttgcctcagtggaacactgtgatttggacagggaatgcatcctgacttctgcacaccggtatatcacctttcctgcatccttaattaaacaaatcctgagcatttacaattcaaccagtatgcattcagcacctactgtgagccaggcccagttctaggagctgggagagaagggcggtgacaaaagagaccaaaaatctctcacagagatgataatgtgtcccacatcgccgggcacagtggctcatgcctgtaatccaagcactttgggaggccgaggcgggtggatcacttgaggtcaagagttcgatgccactgcactccagcctagacaacagagcaagactctgtctcaaaaaaaaaaaaaaaaaaaaaaaatttgagaccagcctgaccaacatggtgacaccccttctctactaaaaatacaaaaattaaccaggcacagtgtgtgcctgtaatcccagctactcaggaggctgaggcaggagaatcgcttgaacccaggaggcagaggttgcagtgagccaagatcgtgccgtcgcgctccagcctgggcaaccagagcgaaactctgactcaaaataaataaataaataaataaataaaagtaatgtgtcctacatcgcatggggcctgagaggacaggcaggcactcctaggaccatcatagcagcgacccagccctggtggccagtgcccctcccctcttttctaggacttttctccaagccagtccttcccctgtccccccttgtaagggctgtctggattagaagcctggccccaggggactgcatcctccaagatgctctccccagcctctgtgtgagaaggatggaggtagggaggctttcatgctgcctgccccctgaagctgaatgaccatccctgctgaatgaagtgttggggggaacccttaggtgtttggccttcaagtttgtcagctccagcagctcgtttttctggcagggcctggtatgacacatttggctgtgttctttgctctggagtggacctattgattcttatcgagctaccagctgagggggaaggggaggacaaatagtagggcagacctgggagagaagggaccctggaaaagcctggccagtggacctgccaggtgggaggcagagcacagataaagagcctgagcctggattgttcctgatctgtcacctaatggtggggagagccccacagtgctcaatgggagccagccagggggcagtcagggtggaagctggccaggggagggtcggggcctgctgaaggctgggaggcaaacgggatgcaaaataacatacaaatgaatgcccactggttttgcatacaaggcttctgggaggtaagaggttccagtcagaggggtctctcctgctttcacctttatattcccccactggattccagaactgtcaagttgggcagtattttataataaagtatgtggagtcaacaa

SEQ ID NO: 145504 - DNA, 3894 bp, Homo sapiens
  Payload ID: 8785
  Gene Symbol: KRT80
  Gene Name: keratin 80, type II
  Uniprot ID: Q6KB66
  ENST ID: ENST00000313234
  CDS Start-End: 99-1367
cccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgccccttccctcccctaccccttatgttccctgtagctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccggaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcatttgccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctggtacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaatta

SEQ ID NO: 145505 - DNA, 3859 bp, Homo sapiens
  Payload ID: 8785
  Gene Symbol: KRT80
  Gene Name: keratin 80, type II
  Uniprot ID: Q6KB66
  ENST ID: ENST00000394815
  CDS Start-End: 99-1457
cccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccggaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcatttgccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctggtacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaatta

SEQ ID NO: 145506 - DNA, 1929 bp, Homo sapiens
  Payload ID: 8786
  Gene Symbol: KRT81
  Gene Name: keratin 81, type II
  Uniprot ID: Q14533
  ENST ID: ENST00000327741
  CDS Start-End: 70-1587
cattggagtttccatcaggactccaggtcccctatcctgtcctctgcaacccaaacgtccaggaggatcatgacctgcggatcaggatttggtgggcgcgccttcagctgcatctcggcctgcgggccgcggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatcctcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaatgagctgaaccgcatgatccaaaggctgacggccgaggtggagaatgccaagtgccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaa

SEQ ID NO: 145507 - DNA, 1505 bp, Homo sapiens
  Payload ID: 8786
  Gene Symbol: KRT81
  Gene Name: keratin 81, type II
  ENST ID: ENST00000615839
  CDS Start-End: 51-1505
actccaggtcccctatcctgtcctctgcaacccaaacgtccaggaggatcatgacctgcggatcaggatttggtgggcgcgccttcagctgcatctcggcctgcgggccgcggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatcctcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaatgagctgaaccgcatgatccaaaggctgacggccgaggtggagaatgccaagtgccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaagtggggtcttgcggcagcagctgccggaaatgttag

SEQ ID NO: 145508 - DNA, 2664 bp, Homo sapiens
  Payload ID: 8787
  Gene Symbol: KRT82
  Gene Name: keratin 82, type II
  Uniprot ID: Q9NSB4
  ENST ID: ENST00000257974
  CDS Start-End: 79-1620
gggaagctgagcctgacttgatcatcctgccccggttctttcctccagggccgcatttctctgcctctctctcctgccatgtcgtaccactctttccagccaggctccaggtgtggcagtcagagtttcagctcatactcggctgtcatgccccggatggtcacccactatgcagtgagcaaggggccatgccggcccgggggtggtaggggcctccgagctctgggctgccttggctcacggagcctgtgcaacgtgggctttgggaggccccgggtagcctccaggtgtggaggtaccctgcctggcttcgggtaccgactgggagccacctgtgggccttctgcctgcatcacccctgtcaccatcaatgagagcctgctggtcccactggcactggagatagacccgactgtgcagagggtaaagagggatgagaaggagcagatcaagtgcctcaacaaccgtttcgcatctttcatcaacaaggtccgtttcctggagcagaagaacaagctgctggagaccaagtggaacttcatgcagcagcagaggtgctgccagaccaacatcgagcccatcttcgagggctatatcagcgcccttcggcggcagctggactgtgtgtccggggaccgcgtgaggctagagtcagagctctgcagcctccaggctgcactggagggctacaagaaaaaatacgaagaggagctctccctgcgtccctgtgttgagaatgagtttgttgccttgaagaaggacgtggacacagccttcctgatgaaggctgacctggagaccaacgcagaggcactcgtgcaggagatcgacttcctgaaaagcctgtatgaggaggagatctgcctgctccagtctcagatctctgagacctcggtcattgtgaagatggacaacagccgggagctggacgtggacggcatcatcgctgagatcaaggcgcagtatgacgacatcgccagccgcagcaaagccgaagcagaggcctggtaccagtgccggtatgaggagctgagagtcacagctgggaaccactgtgacaacctccgcaaccgtaagaacgagatcctggaaatgaataaactgatccagcggctgcagcaagaaaccgagaatgtcaaagcccagcgctgcaaacttgagggtgccatagctgaggcagagcagcagggcgaggcggctctcaatgatgccaagtgcaagctggcagggctggaggaggctctgcagaaggccaagcaggacatggcctgcctgctcaaggaatatcaggaggtgatgaactccaagctgggcctggacatcgagatcgccacctacaggcgcctgctggagggtgaagagcacaggctgtgcgaaggcatcgggcccgtgaatatctcagtgagcagctccaaaggcgccttcctgtacgagccatgtggggtcagcacgcctgtcctcagcactggcgtcctcaggagcaatgggggctgcagcatcgtgggcactggtgaactctatgtcccctgcgagccccaggggctactgagctgtgggagcgggcggaaatccagcatgacgctaggagctgggggcagctcccccagccacaagcattagcatgatccgagacatccaggagacagagcccctgccccatggccctggatgtcacactcccaccagggctgaagacaaggatgttccaaaaccccacctccctttattgactccacattcccctccagtgttccctccttgagagctgagctgcccctaggacccctcctttgcctcatgagtcaccttccactcacctgtgtgcagaccctcagctaggcccagatggtggggacagacggcagagaaagagcatgcattgctcttaaccgcagaatggcaataacccccaaaaggtcaaatgggcacaccacagttctgctctgtggatcatcccatggaagtttcctcacaaagtcagctcctctcccaccacaggctcacactgcccttactttaggctctcatgcccctaagaaaagtgaatttcctttaacaccgcctgaaacatgcacactgcaaatatcaaaaggagacacccccaaatcccactctaaattccaaagccaagtgccacgatttcaggatcagtcaggacctgccaatgtcctctcagcacagagaatcaagaggtggcctttgggcagtagatttactttctcaggtatgttgaacccaaactgtgagaataaatctttctcctgagctcacattggcaggtgatgtcaggccaatgcctagaacaaagggcaaagggatatggaatgtttactggacagttggaaaaccaaaaacagataccattttctcaatggaatcagttccccctccacccatccccttctgtacatagccgccccttcctgttccccaaccctttagctccttttgctttgagtctgatatgacagtgatgtggggctgccccagctgacttggaggccctggctcaggagctcatagatggaggaggtgtgggctgactacctcccagaagcccctcatgccaagcctgtcccactggggctccagggcctctgccctgaacatctgggcttctgttcaaaataaacctactctgttcatggattatagcaatcagga

SEQ ID NO: 145509 - DNA, 1875 bp, Homo sapiens
  Payload ID: 8788
  Gene Symbol: KRT83
  Gene Name: keratin 83, type II
  Uniprot ID: P78385
  ENST ID: ENST00000293670
  CDS Start-End: 64-1545
acaggcccttggttccatcctctgccatctactccactgttcagacacctcctaacctccgtcatgacctgtggcttcaactccataggctgtgggttccgccctggaaacttcagctgtgtctctgcctgcgggccccggccaagccgctgctgcatcaccgccgccccctaccgcggcatctcctgctaccgcggcctcaccgggggctttggcagccacagcgtgtgcgggggcttccgcgccggctcctgcggacgcagcttcggctaccgctccgggggcgtgtgcggacccagccccccatgcatcaccaccgtgtcggtcaacgagagcctcctcacgcccctcaacctggagatagaccccaacgcgcagtgcgtgaagcaggaggagaaggagcagatcaagtccctcaacagcagattcgcggccttcatcgacaaggtgcgcttcctggagcagcagaacaagctgctggagacaaagctgcagttctaccaaaaccgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtatgaagaagaagtagcacttcgagccacagcagagaacgagtttgtggctctaaagaaggatgtggactgcgcctacctccgcaagtcagacctggaggccaacgtggaggccctgatccaggagattgacttcctgaggcggctgtacgaggaggagatccgcattctccaatcccacatctcagacacctccgtggttgtcaagctggacaacagccgggacctgaacatggactgcatcgttgccgagatcaaggcacagtatgatgacattgccacccgtagccgggctgaggccgagtcctggtatcgcagcaagtgtgaggagatgaaggccacagtgatcaggcacggggagaccctgcgccgcaccaaggaggagatcaacgagctgaaccgcatgatccagaggctgacagccgaggtggagaatgccaagtgccagaactccaagctggaagctgcggtggcccagtctgagcagcagggtgaggcggccctcagtgatgcccgctgcaagctggccgagctggagggcgccctgcagaaggccaagcaagacatggcctgcctgatcagggagtaccaggaggtgatgaactccaagctaggcctggatatcgagatcgccacctacaggcgcctgctggagggcgaggagcagaggctgtgtgaaggtgttgaagctgtgaatgtctgtgtcagcagctcccggggtggggttgtgtgcggggatctctgcgtgtcgggctcccggccggtgacgggcagcgtctgcagtgccccctgcaacgggaacctggtggtgagcactggtttgtgcaagccctgtggccagctgaacaccacctgtggagggggctcctgcggccaggggaggcattaagtggcccaaaagagagccaggggagccccttctgcctgccagacgtgccactgccccaccaccagctgaaaacagcagcacatcgctggcttttccccttgtgttctgagaatacaccatcggctcattcccaccagcggctcctccccacctttcatcccactggaaaggggcctgtggctggggaatagacccattccttcccctgtctcagccttcagcccctcccggggagaagggccttgcttccctggaagaagcactgtgagactgttccccctgcctctctggcctcttgtctccccttttccaataaacttggggacctgc

SEQ ID NO: 145510 - DNA, 2092 bp, Homo sapiens
  Payload ID: 8789
  Gene Symbol: KRT84
  Gene Name: keratin 84, type II
  Uniprot ID: Q9NSB2
  ENST ID: ENST00000257951
  CDS Start-End: 68-1870
agagggactcccagctccagctcacccattctacacttgctcttttgctcccaaccaggaagccatcatgtcttgccgctcctaccgagtcagctctggtcaccgggtgggcaacttcagctcttgttcagcaatgacaccacagaacctgaatcgcttccgggccaactctgtctcctgttggagtgggcctggattccggggccttggcagctttggtagtcggagtgtcatcacctttggatcgtactcaccccggatagcagctgtaggctctcggcccatccactgtggagtccgctttggtgctggctgtgggatgggttttggtgatgggagaggtgttggtctggggcctagggctgacagctgtgttggtctgggctttggagctggcagtggcattggctatggctttggtggccctggctttggttacagagttggaggggttggagtcccagcagccccatctatcacagctgtgactgtgaacaagagcctactgacccccctcaacctggagattgaccccaatgcccagagggtgaagaaggatgagaaggagcaaatcaagaccctcaacaacaagtttgcctccttcattgacaaggttcggttcctagagcagcagaataagctcctagagaccaagtggagcttcctccaagagcagaaatgtatcaggagcaatctggagccactcttcgagagctacatcaccaacctgcggaggcagttggaggtgctggtcagtgatcaggcccggctccaggctgagaggaaccacctgcaggatgtcctagagggcttcaagaagaagtatgaagaggaagtggtatgtcgggccaatgctgagaatgagtttgtggctctgaagaaggatgtggatgcagctttcatgaacaagtctgatctcgaggccaacgtggataccctaactcaggaaattgactttctaaaaacgctttacatggaggaaatccagttgctgcagtcgcacatctcagagacgtcggtcattgtgaagatggacaacagccgtgacctgaaccttgatgggatcattgctgaggtcaaggcccagtatgaggaggtggccaggcgcagccgggctgatgctgaggcctggtaccagaccaagtatgaagagatgcaggtgacagctggccaacactgtgacaacctgcgcaacatacggaacgagatcaacgaactgacccgcctgatccagaggcttaaggcagagattgagcacgccaaggctcagcgtgccaagttggaggctgcagtggccgaggccgagcagcagggcgaggcgaccctcagtgatgccaaatgcaagctggcagatctggagtgtgccctgcagcaggccaagcaggacatggcgcggcagctgtgcgagtaccaggagctgatgaatgccaagctgggcctggacatcgagatcgccacctacaggcgcctgctggagggcgaggagagccggctctgtgaaggtgttggaccagtaaacatatccgtcagcagctcccggggcggcctggtgtgcgggcctgagcctttggttgccggctccaccctctcccgcggcggggtcaccttctcaggtagcagcagcgtctgtgccaccagtggggtcctggcttcctgtggccccagcctgggtggagcccgggtcgccccggccactggggacctgctgagcactggcacaaggagtggctccatgctcatcagcgaggcctgtgtccccagcgtcccctgccccctgcccacccaggggggcttcagcagctgcagcggcggccgcagctccagcgtccgctttgtgtccaccaccacctcctgccggaccaagtactgagagcccagccccagacagctgctgcccagagaagaaccagctccacggctcctgcttctgcccccagggttcgtgggctctgggcttgacggtctccagctcccctttctgccaggaagccaccccttagcactcccccgattattctgcctggccccatgtcctcttggaggatttttctgccatgtagatgctccattagcagttccagctaagctggct

SEQ ID NO: 145511 - DNA, 2447 bp, Homo sapiens
  Payload ID: 8790
  Gene Symbol: KRT85
  Gene Name: keratin 85, type II
  Uniprot ID: P78386
  ENST ID: ENST00000257901
  CDS Start-End: 77-1600
agaaggatcctgagcctcgcactctgccgcccgcaccaccttccgctgcctctcagactctgctcagcctcacacgatgtcgtgccgctcctacaggatcagctcaggatgcggggtcaccaggaacttcagctcctgctcagctgtggcccccaaaactggcaaccgctgctgcatcagcgccgccccctaccgaggggtgtcctgctaccgagggctgacgggcttcggcagccgcagcctctgcaacctgggctcctgcgggccccggatagctgtaggtggcttccgagccggctcctgcggacgcagcttcggctaccgctccgggggcgtgtgcggacccagccccccatgcatcactaccgtgtcggtcaacgagagcctcctcacgcccctcaacctggagatcgaccccaacgcacagtgcgtgaagcaggaggagaaggagcagatcaagtccctcaacagcaggttcgcggccttcatcgacaaggtgcgcttcctggagcagcagaacaagctgctggagaccaagtggcagttctaccagaaccagcgctgctgcgagagcaacctggagccactgttcagtggctacatcgagactctgcggcgggaggccgagtgcgtggaggccgacagcgggaggctggcctcagagctcaaccatgtgcaggaggtgctggagggctacaagaagaagtatgaagaggaggtggccctgagagccacagcagagaatgagtttgtcgttctaaagaaggacgtggactgtgcctacctgcggaaatcagacctggaggccaatgtggaggccctggtggaggagtctagcttcctgaggcgcctctatgaagaggagatccgcgttctccaagcccacatctcagacacctcggtcatagtcaagatggacaacagccgagacctgaacatggactgcatcatcgctgagatcaaggctcagtatgacgatgttgccagccgcagccgggccgaggctgagtcctggtaccgtagcaagtgtgaggagatgaaggccacggtgatcaggcatggggagaccctgcgccgcaccaaggaggagatcaacgagctgaaccgcatgatccagaggctgacggccgagattgagaatgccaagtgccagcgtgccaagctggaggctgctgtggctgaggcagagcagcagggtgaggcggccctcagcgatgcccgctgcaagctggctgagctggagggcgccctgcagaaggccaagcaggacatggcctgcctgctcaaggagtaccaggaggtgatgaactccaagctgggcctggacatcgagatcgccacctacaggcgcctgctggagggcgaggaacacaggctgtgtgaaggtgtgggctctgtgaatgtctgtgtcagcagctcccgtggtggagtctcctgtgggggcctctcctacagcaccaccccagggcgccagatcacttctggcccctcagccataggcggcagcatcacggtggtggcccctgactcctgtgccccctgccagcctcgttcctccagcttcagctgcgggagtagccggtcggtccgctttgcctagtagagtcatggagccagggcttcctgccaagcacctgcctgcctgcatcactgcactgaatggcatgtgaatggaaaatgtgtgcttgcttccagaatcttctggatgttcctacagagggaaagacctacagagggaaagaccctcgggccgctcccctgcgccttttcatgctagggagatgcatcctagttgtcctcctggcagctgttttcagaggcattcccagcccttcacttaactcctacttagctccaaaatacctgtatccaatttgtattattcccccagctctcagggacaagaccagtcccccagcgtggtggtcagcacggaagctccaccttctgggtggaggcgccatcctaaccatccagccaggccacccacaacccgagaatcagggagaaagtccctccccagcagccccctcctcctggctgggaagaatggtcccccagcaagcacttgcctgttcattcctgttcatgttttgcttctctctcagactgccttcctgcttctgggctaacctgttccagccaggctcctcatgtgacctcgcagttgagaagcccattatcgtggggcatccttttgcctacagcccctggttagggcactttggacaggtcttgctattcagtgaacctttgtacatttcaaagaagactccatggctgctccagatgcccccttgctgggtgcaggtggggactgtccaatgcagagctggcgggacagagagttaagccacttcctgggtctccttcttgtgactgtctatgggtgcattgccttctgggttgtctcgatctgtgtttcaataaatgccgctgcaatgcaa

SEQ ID NO: 145512 - DNA, 1387 bp, Homo sapiens
  Payload ID: 8790
  Gene Symbol: KRT85
  Gene Name: keratin 85, type II
  ENST ID: ENST00000544265
  CDS Start-End: 203-1090
acagatgattttagacttgggggaaggaatgtgcattcctaaccccatctcagaggcagaaggactgcggcggaatgaagccaggctaggacaagggctggcccatgaataatacaaaaaatagatcctggaggggccaagacaacatctggaggggattaatcccttttcaatccccggaagaacttgcccaggagttgggatggtattcaaggtccagtttctcagctccagaccttctctctcccacacccaggacgtggactgtgcctacctgcggaaatcagacctggaggccaatgtggaggccctggtggaggagtctagcttcctgaggcgcctctatgaagaggagatccgcgttctccaagcccacatctcagacacctcggtcatagtcaagatggacaacagccgagacctgaacatggactgcatcatcgctgagatcaaggctcagtatgacgatgttgccagccgcagccgggccgaggctgagtcctggtaccgtagcaagtgtgaggagatgaaggccacggtgatcaggcatggggagaccctgcgccgcaccaaggaggagatcaacgagctgaaccgcatgatccagaggctgacggccgagattgagaatgccaagtgccagcgtgccaagctggaggctgctgtggctgaggcagagcagcagggtgaggcggccctcagcgatgcccgctgcaagctggctgagctggagggcgccctgcagaaggccaagcaggacatggcctgcctgctcaaggagtaccaggaggtgatgaactccaagctgggcctggacatcgagatcgccacctacaggcgcctgctggagggcgaggaacacaggctgtgtgaaggtgtgggctctgtgaatgtctgtgtcagcagctcccgtggtggagtctcctgtgggggcctctcctacagcaccaccccagggcgccagatcacttctggcccctcagccataggcggcagcatcacggtggtggcccctgactcctgtgccccctgccagcctcgttcctccagcttcagctgcgggagtagccggtcggtccgctttgcctagtagagtcatggagccagggcttcctgccaagcacctgcctgcctgcatcactgcactgaatggcatgtgaatggaaaatgtgtgcttgcttccagaatcttctggatgttcctacagagggaaagacctacagagggaaagaccctcgggccgctcccctgcgccttttcatgctagggagatgcatcctagttgtcctcctggcagctgttttcagaggcattcccagcccttcacttaactcctacttagctccaaaatacctgtatccaatttgtattattcccccagctctca

SEQ ID NO: 145513 - DNA, 2091 bp, Homo sapiens
  Payload ID: 8791
  Gene Symbol: KRT86
  Gene Name: keratin 86, type II
  Uniprot ID: O43790
  ENST ID: ENST00000293525
  CDS Start-End: 53-1513
tccattcggacgtctccatcctcagaacctcctctcttccccaaaaagcaccatgacttgtggatcttactgtggtggccgcgccttcagctgcatctcggcctgcgggccccggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatttgttgtcccgaggattcatctttttcttccgcctgccttctgttttttttgctgtatacattggtcttgcctgagctcttccccaaagcttggaggaacgggggaggcccgggaatgtccctgtctgcacgacctgggactctgcccatgtgcttttgcctgtggaatggagacgcggaccctggatagtggttctatgactctgcgagggacaggcccacgcgtgtggggagaacatctcccttccggggctgccctcaagagcttctgaaaaactaatgactctgctgccttctcctttgtctttgtttcactctgtgtttccaataaactcattgtagcgaatcaa

SEQ ID NO: 145514 - DNA, 2217 bp, Homo sapiens
  Payload ID: 8791
  Gene Symbol: KRT86
  Gene Name: keratin 86, type II
  Uniprot ID: O43790
  ENST ID: ENST00000423955
  CDS Start-End: 179-1639
tttggtgctcaagagaggcttggaggagaccacagttctttctccatgtgtgaggaattaaaggcaactgtgcagaaacacacgcagagcctgaagcccagcaaggaggatctgaacaggcttaatcaggccatccagtggctgacggtggaggtgggcagtgctgagagtcagcaccatgacttgtggatcttactgtggtggccgcgccttcagctgcatctcggcctgcgggccccggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatttgttgtcccgaggattcatctttttcttccgcctgccttctgttttttttgctgtatacattggtcttgcctgagctcttccccaaagcttggaggaacgggggaggcccgggaatgtccctgtctgcacgacctgggactctgcccatgtgcttttgcctgtggaatggagacgcggaccctggatagtggttctatgactctgcgagggacaggcccacgcgtgtggggagaacatctcccttccggggctgccctcaagagcttctgaaaaactaatgactctgctgccttctcctttgtctttgtttcactctgtgtttccaataaactcattgtagcgaatcaa

SEQ ID NO: 145515 - DNA, 562 bp, Homo sapiens
  Payload ID: 8791
  Gene Symbol: KRT86
  Gene Name: keratin 86, type II
  ENST ID: ENST00000553310
  CDS Start-End: 134-562
agtttcgggtggcccagccaactttcatgccagccgtcctcagcccttcctggtgctgggtctgccaggctcatggtcagccaggcctggggccctggagaggtcctctgcatcttgaattctgtggagcaccatgacttgtggatcttactgtggtggccgcgccttcagctgcatctcggcctgcgggccccggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaac

SEQ ID NO: 145516 - DNA, 2290 bp, Homo sapiens
  Payload ID: 8792
  Gene Symbol: KRT9
  Gene Name: keratin 9, type I
  Uniprot ID: P35527
  ENST ID: ENST00000246662
  CDS Start-End: 67-1938
ccctgcacttgggagccggtagcactcctatcactgcttctcaacccgtgagctaccagctgtgtcatgagctgcagacagttctcctcgtcctacttgagccgcagcggcgggggtggcgggggcggcctgggcagcgggggcagcataaggtcttcctacagccgcttcagctcctcagggggcggtggaggagggggccgattcagctcttctagtggctatggtgggggaagctctcgtgtctgtgggaggggaggcggtggcagttttggctacagctacggcggaggatctgggggtggttttagtgccagtagtttaggcggtggctttgggggtggttccagaggttttggtggtgcttctggaggaggctatagtagttctgggggttttggaggtggctttggtggtggttctggaggtggctttggtggtggctatgggagtgggtttggggggtttgggggctttggaggtggtgctggaggaggtgatggtggtattctgactgctaatgagaagagcaccatgcaggaactcaattctcggctggcctcttacttggataaggtgcaggctctagaggaggccaacaacgacctggagaataagatccaggattggtacgacaagaagggacctgctgctatccagaagaactactccccttattataacactattgatgatctcaaggaccagattgtggacctgacagtgggcaacaacaaaactctcctggacattgacaacactcgcatgacactggatgacttcaggataaagtttgagatggagcaaaacctgcggcaaggagtggatgctgacatcaatggcctgcggcaggtgctggacaatctgaccatggagaagtctgacctggagatgcagtatgagactctgcaggaggagctgatggccctcaagaagaatcataaggaggagatgagtcagctgactgggcagaacagtggagatgtcaatgtggagataaacgttgctcctggcaaagatctcaccaagaccctcaatgacatgcgtcaggagtatgagcagctcattgctaagaacagaaaggacatcgagaatcaatatgagactcagataacccagatcgagcatgaggtatccagtagtggtcaggaggtgcagtccagtgccaaggaggtgacccagctccggcacggtgtccaggagttggagattgagctgcagtctcagctcagcaagaaagcagctctggagaagagcttggaagacacgaagaaccgctactgtggccagctgcagatgatccaggagcagatcagtaacttggaggcccagatcactgacgtccggcaagagatcgagtgccagaatcaggaatacagccttctgctcagcattaagatgcggctggagaaggaaatcgagacctaccacaacctccttgagggaggccaggaagactttgaatcctccggagctggaaaaattggccttggaggtcgaggaggaagtggaggcagttatggaagaggatccaggggaggaagtggaggcagctatggtggaggaggaagtggaggtggctatggtggaggaagtgggtccaggggaggaagtggaggcagctacggtggaggaagtggttctggaggaggtagtggaggtggctatggtggaggaagtggaggtggccatagcggaggaagtggaggtggtcatagtggaggaagtgggggcaactatggaggaggaagtggctctggaggaggaagtgggggtggctatggtggaggaagtgggtccaggggaggaagtggaggcagccatggtggaggaagtggttttggaggtgaaagtggaggcagctacggaggcggtgaagaagcgagtggaagtggtggcggctacggaggaggaagcggaaaatcatcccattcctagtcttcttcctcaaaatctggtgaccaagatgagacaaaaggcttcctttcgcgatactagagcctctgtaaacttctcctgcccagccccagctgagcatccccagatgggcagactcccgatgaagcctgcttattggatcctgacatcaggaatagctggcaacaagcccctgtgcccgtttgggactgaactgacttggcatatgtgcctctggctttccattggcttccaaccctgcttggctttgatgccttcagggttggggagacagacctctttcctctctctggcctggggtgctctcacaccctgcacgatcttgactataataaagcttccctactgcaaa

SEQ ID NO: 145517 - DNA, 1493 bp, Homo sapiens
  Payload ID: 8792
  Gene Symbol: KRT9
  Gene Name: keratin 9, type I
  ENST ID: ENST00000588431
  CDS Start-End: 232-1404
cacttgggagccggtagcactcctatcactgcttctcaacccgtgcaggctctagaggaggccaacaacgacctggagaataagatccaggattggtacgacaagaagggacctgctgctatccagaagaactactccccttattataacactattgatgatctcaaggaccagattgtggacctgacagtgggcaacaacaaaactctcctggacattgacaacactcgcatgacactggatgacttcaggataaagtttgagatggagcaaaacctgcggcaaggagtggatgctgacatcaatggcctgcggcaggtgctggacaatctgaccatggagaagtctgacctggagatgcagtatgagactctgcaggaggagctgatggccctcaagaagaatcataaggaggagatgagtcagctgactgggcagaacagtggagatgtcaatgtggagataaacgttgctcctggcaaagatctcaccaagaccctcaatgacatgcgtcaggagtatgagcagctcattgctaagaacagaaaggacatcgagaatcaatatgagactcagataacccagatcgagcatgaggtatccagtagtggtcaggaggtgcagtccagtgccaaggaggtgacccagctccggcacggtgtccaggagttggagattgagctgcagtctcagctcagcaagaaagcagctctggagaagagcttggaagacacgaagaaccgctactgtggccagctgcagatgatccaggagcagatcagtaacttggaggcccagatcactgacgtccggcaagagatcgagtgccagaatcaggaatacagccttctgctcagcattaagatgcggctggagaaggaaatcgagacctaccacaacctccttgagggaggccaggaagactttgaatcctccggagctggaaaaattggccttggaggtcgaggaggaagtggaggcagttatggaagaggatccaggggaggaagtggaggcagctatggtggaggaggaagtggaggtggctatggtggaggaagtgggtccaggggaggaagtggaggcagctacggtggaggaagtggttctggaggaggtagtggaggtggctatggtggaggaagtggaggtggccatagcggaggaagtggaggtggtcatagtggaggaagtgggggcaactatggaggaggaagtggctctggaggaggaagtgggggtggctatggtggaggaagtgggtccaggggaggaagtggaggcagccatggtggaggaagtggttttggaggtgaaagtggaggcagctacggaggcggtgaagaagcgagtggaagtggtggcggctacggaggaggaagcggaaaatcatcccattcctagtcttcttcctcaaaatctggtgaccaagatgagacaaaaggcttcctttcgcgatactagagcctctgtaaacttctcctgcccagccc

SEQ ID NO: 145518 - DNA, 1215 bp, Homo sapiens
  Payload ID: 8793
  Gene Symbol: KRTAP10-1
  Gene Name: keratin associated protein 10-1
  Uniprot ID: P60331
  ENST ID: ENST00000400375
  CDS Start-End: 46-894
tcactcactcacacctcccgcagctcacctcctccccaccccagcatggccgcgtccaccatgtccgtctgctccagcgcttgctccgactcctggcaggtggatgcctgcccagagagctgctgtgagccccactgctgcgccctcagctgctgcgccccggccccctgcctgaccctggtctgcaccccagtgagccgtgtgtccagcccctgctgccaggcagcctgtgagcccagcccctgccaatcaggctgcaccagctcctgcacgccctcgtgctgccagcagtctagctgccagccggcttgctgcacctcctccccctgccagcaggcctgctgcgtgcccgtctgctgcaagcctgtgtgctgcctgcccacctgctctaaggattcctcttcatgctgccagcagtctagctgccagccaacttgctgtgcctcttcctccagccagcagtcctgctgtgtgcctgtttgctgcaagcctgtgtgctatgtgcccacctgctctgaggattcctcttcatgctgccagcagtctagctgccatccagcttgctgcacctcctccccctgccagcaggcctgctgcgtgcccgtccgttgcaagcctgtctgctgcaagcccatctgctgtgtgcccgtctgctctggggcttccacttcatgctgccagcagtctagctgccagccggcttgctgcaccacctcctgctgcagaccctcctcctccgtgtccctcctctgccgccctgtatgccggcccgcctgctgtatgcctgtctcctcctgctgtgcccctgcctcctcctgccaggccagctgctgccgcccggcctcctgcgtgtccctcctctgccgccccgcgtgctcccgcccggcctgctgaggcctctgctcaggccaggagtccagctgctgatgggcacccgccctgggccagctgggctcagttcctgacctgggttaggtggcttcccccacctaggacgggtccccgtgtctcccctgtgctgaggtgaccccccctccttgctcccaggagcctccatccttgcagctccccagctcttgccttccagcaggtgcccacctgcctgctaggtcccctgtcctccctcccagcttctctgctctgggtcacttggcctcgacttgaacctctcagcacctcctcctgctccccaataaactctccttggtcacctga

SEQ ID NO: 145519 - DNA, 1100 bp, Homo sapiens
  Payload ID: 8794
  Gene Symbol: KRTAP10-10
  Gene Name: keratin associated protein 10-10
  Uniprot ID: P60014
  ENST ID: ENST00000380095
  CDS Start-End: 63-818
cactcactcacacactcactcactcacacacctcccccagctcaccgcctccccactccagcatggccgcctccaccatgtccatctgctccagcgcctgcactgactcttggcgggtagtcgactgcccagagagctgctgcgagccctgctgctgtgccccagcccccagcttgaccctggtctgcaccccagtgagctgtgtgtccagcccctgctgccagacggcctgtgagcccagcgcctgccaatcaggctacaccagctcctgcacaaccccatgctaccagcagtctagctgccagccggattgctgcacctcctccccctgccagcaggcctgctgtgtgcctgtctgctgtgtgcccgtctgctgcgtgcccgtctgtaacaagcctgtgtgcttcgtgcctacctgctccgagtcttccccttcatgctgccagcagtctagctgccagccaacttgctgcacctcctccccatgccagcaggcctgctgtgtgcctgtctgctctaagtccgtctgctatgtgcctgtgtgctctggggcttccacttcatgctgccagcagtctagctgccagcctgcttgctgcaccgcctcctgctgcagaccctcctcctccgtgtccctcctctgccaccctgtgtgcaagtccacctgctgcgtgcccgtcccctcctgcggtgcctctgcctcctcctgccagcccagctgctgccgcacggcctcctgtgtttccctcctctgccgccccgtgtgctcccgccctgcctgctacagcctctgctctggccagaagtccagctgctgacagccctggatgtgatccggagtcccttcccaccaggggctgacctcccagctgccccagcaagctctgccctctctggctttgacaccctcagaaggtggggcaggctctttgtcttggggaccaggatgctcccccagtccttcccagatgatggctgcctgtgggaccccagctactcccccagacccaagttctgcagaactaacccccagcaggcctggttccaccctgggcagcaccccctctagttctaataaagccgcctctgtctcacaccaa

SEQ ID NO: 145520 - DNA, 1237 bp, Homo sapiens
  Payload ID: 8795
  Gene Symbol: KRTAP10-11
  Gene Name: keratin associated protein 10-11
  Uniprot ID: P60412
  ENST ID: ENST00000334670
  CDS Start-End: 46-942
acactcacttacacctcccccagctcacctcctccccaccccagcatggccgcgtccaccatgtctgtctgctccagcgcttactccgactcctggcaggtggacgactgcccagagagctgctgtgagcccccctgcagcgcccccagctgctgcgccccggccccctccctgagcctggtctgcaccccagtgagctgtgtgtccagcccctgctgccaggcggcctgtgagcccagcgcctgccaatcaggctgcaccagctcctgcacgccgtcatgctgccagcagtctagctgccagccggcttgctgcacctcctccccctgccagcaggcctgctgtgtgcctgtctgctgcaagactgtctgctgcaagcctgtgtgctgtgtgcctgtctgctgtggggctgcttcttcgtgctgccggcagtctagctgccagccagcttgctgtgcctcttcctcctgccagccggcctgctgtgtgcccgtctgctgcaagcctgtgtgctgtgtgtccacctgctctgaggattcctcttcatgctgccagcagtctagctgccagccagcttgctgcacctcctcctcctaccagcaggcctgctgcgtgcctgtctgctgcaagactgtctactgcaagcccatctgctgtgtgcctgtctgctctagggcttcctcttcacgctgccagcagcctagctgccagccagcttgctgcaccacctcctgctgcagaccctcctcctctgtgtccctcctctgccaccccgtgtgcaggtccacctgctgtgtgcccgtctcctcctgctgtgcccccacctcctcctgccagtccagctgctgccgcccggcctcctgcgtgtccctcctctgccgccccgcaagctcccgcctggcctgctacagcctctgctcaggcaagaagtccagctgctgagtgctcaatccttgtctcctgctgactgtgtctttgctgccaagcaggattctccagtctcaggagcccctggagtcctcagaatccaccagctccatcagtagccacagagctgctgcctgaaggggattttgagcgcgtcacactttcctccccactgtctgggaagagacaacccacaaatccctcagcaggtggactgtggctttctggagcccccttctccaaatgtgttgcttatacccaatgtgacaaagaagaactgctctaatcaataaattcttgagtcaggaaa

SEQ ID NO: 145521 - DNA, 873 bp, Homo sapiens
  Payload ID: 8796
  Gene Symbol: KRTAP10-12
  Gene Name: keratin associated protein 10-12
  Uniprot ID: P60413
  ENST ID: ENST00000400365
  CDS Start-End: 31-768
agctcaacccccagcacggctgcatccaccatgtccgtctgctccagcgacctgagctatggcagccgcgtctgccttcctggttcctgtgactcttgctccgactcctggcaggtggacgactgcccagagagctgctgtgagcccccctgctgcgccccggccccctgcctgagcctggtctgcaccccagtgagccgtgtatccagcccctgctgccgagtgacctgtgagcccagcccctgccaatcaggctgcaccagctcctgcacgccctcgtgctgccagcagtctagctgccagccggcttgctgcacctcctccccctgccagcaggcctgctgcgtgcccgtctgctgcaagactgtctgctgcaagcctgtgtgctgtatgcccgtctgctgtgggccttcttcttcatgctgccagcagtctagctgccagccagcttgctgcatctcctccccgtgtcaacagtcctgctgtgtgcccgtctgctgcaagcccatctgctgtgtgcctgtctgctctggggcctcctctctgtgctgccagcagtctagctgccagccagcttgctgcaccacctcctgctgcagaccctcctcctccgtgtccctcctctgccgccctgtgtgcagacccgcccgccgcgtgcccgtcccctcctgctgtgtccccacctcctcctgccagccaagctgcggccgcctggcctcctgcgggtccctcctctgccgccccacatgttcccgcctggcctgctgaggcctctgctcaggccagaagtccagctgctgccaggcatgtcccccagggccactgggcactatgagtcccccacctctcccactactggcccctcggctgctc

SEQ ID NO: 145522 - DNA, 282 bp, Homo sapiens
  Payload ID: 8796
  Gene Symbol: KRTAP10-12
  Gene Name: keratin associated protein 10-12
  ENST ID: ENST00000618832
  CDS Start-End: 1-282
tgcaccagctcctgcacgccctcgtgctgccagcagtctagctgccagccggcttgctgcacctcctccccctgccagcaggcctgctgcgtgcccgtctgctgcaagactgtctgctgcaagccttctagctgccagccagcttgctgcatctcctccccgtgtcaacagtcctgctgtgtgcccgtctgctgcaagcccatctgctgtgtgcctccagcttgctgcaccacctcctgctgcagaccctcctcctccgtgtccctcctctgccgccctgtg

SEQ ID NO: 145523 - DNA, 1149 bp, Homo sapiens
  Payload ID: 8797
  Gene Symbol: KRTAP10-2
  Gene Name: keratin associated protein 10-2
  Uniprot ID: P60368
  ENST ID: ENST00000391621
  CDS Start-End: 48-815
tcactcactcacacacctcccccagctcacctcctccccactccagcatggccgcctccaccatgtccatctgctccagcgcctgcaccaactcctggcaggtggacgactgcccagagagctgctgtgagctcccctgcggcacccccagctgctgtgccccagccccctgcctgaccctggtctgcaccccagtgagctgtgtgtccagcccctgctgccaggcggcctgtgagcccagcgcctgccaatcaggctgcaccagctcctgcacgccctcgtgctgccagcagtctagctgccagccggcttgctgcacctcctccccctgccagcaggcctgctgcgtgcccgtctgctgcaagcctgtgtgctgtgtgcccgtctgctgtggggcttcttcatgctgccagcagtctagctgccagccagcttgctgtgcctcttcctcctgccagcagtcctgccgtgtgcctgtctgctgcaaagctgtgtgctgcgtgcccacctgctctgagtcatcctcttcatgctgccagcagtctagctgccagccggcttgctgcacctcctccccgtgtcagcagtcctgctgtgtgtccgtctgctgcaagcctgtctgctgcaagtccatctgctgtgtacctgtttgctctggggcttcctctccgtgctgccagcagtctagctgccagccagcttgctgcacctcctcctgctgcagaccctcctcctctgtgtccctcctctgccgccccgtgtgctcccgcccagcctcctgcagcttttcctcaggccaaaagtctagctgctgatggccatgtcccccagggccagccgggctcaggccccacctccctgccagtccttggacctcccagcccacccagcctcagcacagctcagcacagaaggagcagccccagccacagccgcccagccccggggtctcagatgctcactggctcctctctgacctcccgccgggcgggcgagccctggcttctcctcacggtgcttcctggctgcagaccacaaccctccgctggtcgctggtcgctggttggggatgggccctcctgacctgggtctcacccccaggagcgtcaccctctgcctctgagcaccaataaagcgtctgcggcccca

SEQ ID NO: 145524 - DNA, 971 bp, Homo sapiens
  Payload ID: 8798
  Gene Symbol: KRTAP10-3
  Gene Name: keratin associated protein 10-3
  Uniprot ID: P60369
  ENST ID: ENST00000391620
  CDS Start-End: 46-711
tcactcactcacgtctcccccagctcacctcctccccaccccagcatggccacgtctaccatgtccgtctgctccagcgcttactctgactcctggcaggtggacgcctgcccagagagctgctgtgagcccccctgctgcgccaccagctgctgcgccccggccccctgcctgaccctggtctgcaccccagtgagctgtgtgtccagcccctgctgccaggcggcctgtgagcccagcccctgccagtcaggctgcaccagctcctgcacgccctcgtgctgccagcagtctagctgccagccagcttgctgcacatcctccccctgccagcaggcctgctgcgtgcctgtctgctgcaagccagtctgctgtgtgcccgtctgctgcaagcctgtctgctgcaagcccatctgctgtgtgcccgtctgctctggggcttcctcttcatgctgccagcagtctagccgccagccggcttgctgcaccacctcctgctgcagaccctcctcctccgtgtccctcctctgccgccccgtgtgcaggtccacctgctgtgtgcccatcccctcctgctgtgcccctgcctccacctgccagcccagctgctgccgcccggcctcctgcgtgtccctcctctgccgccccacgtgctcccgcctctcttccgcgtgctgcggcctctcctcaggccagaagtccagctgctgacgggcaggtcccgtttctccagagttgttccagggccatctctgacttccgaaaatccttgcagccctgagccctgtctgagtctcctctgcccatagccactgcacctccagccagcaatgctgagctttcatgccgattccctccaggcatgcatctctcccacaccctcatctccatgctggccagccggtggtcactgtgtcctgccccatgtgagtgatcagtctgtcaacaaataaagtcaccaatgtgccctc

SEQ ID NO: 145525 - DNA, 1643 bp, Homo sapiens
  Payload ID: 8799
  Gene Symbol: KRTAP10-4
  Gene Name: keratin associated protein 10-4
  Uniprot ID: P60372
  ENST ID: ENST00000400374
  CDS Start-End: 31-1236
agctcaacccccagcacagcagcatccaccatgtccgtctgctccagcgacctgagctacagcagccgcgtctgccttcctggttcctgtgactcttgctccgactcctggcaggtggacgactgcccagagagctgctgcgagcccccctgctgcgcccccagctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgcccgtctgctgtggggattcttcatgctgccagcagtctagctgccagtcagcttgctgcacctcctccccctgccagcaggcctgctgtgtgcccatctgctgcaagcctgtctgctctgggatttcctcttcgtgctgccagcagtctagctgtgtgagctgtgtgtccagcccctgctgccaggcggtctgtgagcccagcccctgccaatcaggctgcatcagctcctgcacgccctcgtgctgccagcagtctagctgccagccggcttgctgcacctcctcctcctgccagcaggcctgctgcgtgcccgtctgctgcaagactgtctgctgcaagcctgtgtgctctgaggattcctcttcatgctgccagcagtctagctgccagccggcttgctgcacctcctctccctgccagcaggcttgctgtgtgcctgtctgctgcaagcctgtgtgctgcaagcctgtctgctctgtgcccatctgctctggggcttcctctctgtgctgccagcagtctagctgccagccagcttgctgcacctcctcccaaagccagcagggctgctgcgtgcccgtctgctgcaagcctgtgagctgtgtgcctgtttgctctggggcttcctcttcatgctgccagcaatctagctgccagccagcttgctgcaccacctcctgctgcagaccctcctcctccgtgtccctcctctgccgccccgtgtgcaggcccgcctgctgcgtgcccgtcccttcctgctgtgctcccacctcctcctgccaacccagctgctgccgcccagcctcctgcgtgtccctcctctgacgccccgtgtgctcccgcccagcctgctgaggcctccgctcaggtcagaagcccagctgctgatggacacgccccccagtgccagccaggctcaggtcccacctgaaagctgatagtcgcgtcctgaattgctcctgcactttgaccatttcctggtgtctgctgttgagctggacaatggaagaactgaaagtctatactcaatgctgcagccctcttgcggggggaggggggcgcttctagaaagttcccatggcagtggcctcccctccatatctcccacctctcatgagggtcagttcagccttgacccgtgaggtctctgtcctcctggctcagagccgcagagccttctttggacgccctcaagctgaccaataaaggccctgagactgcaatggcgctga

SEQ ID NO: 145526 - DNA, 1150 bp, Homo sapiens
  Payload ID: 8800
  Gene Symbol: KRTAP10-5
  Gene Name: keratin associated protein 10-5
  Uniprot ID: P60370
  ENST ID: ENST00000400372
  CDS Start-End: 27-842
ccagctcacgtcttccccaccccagcatggccgcgtgcaccatgtccgtctgctccagcgcttgctctgactcctggcgagtggacgactgcccagagagctgctgtgagcccccctgcggcaccgccccctgcctgaccctggtctgcaccccagtgagctgtgtgtccagcccctgctgccaggcggcctgtgagcccagcccctgccaatcaggctgcaccagctcctgcacgccctcgtgctgccagccggcttgctgcgcctcctccccctgccagcaggcctgctgcgtgcccgtctgctgcaagcctgtgtgctgcctgcccacctgctctaaggattcctcttcatgctgccagcagtctagctgccagccaacttgctgtgcctcttcctcctgccagcagtcctgctgtgtgcctgtctgctgcaagcccgtgtgctgtgtgcccacctgttctgaggattcctcttcatgctgccagcattctagctgccagccgacttgctgcacctcctccccctgccagcagtcctgctacgtgcctgtctgttgcaagcctgtctgctgcaaacccatctgctgtgtgcccgtctgctctggggcttccacttcatgctgccagcagtctagctgtcagccggcttgctgcaccacctcctgctgcagaccctcctcctccgtgtccctcctctgccgccccatatgcaggcccgcctgctgcctgcccatctcctcctgctgtgcccctgcctcctcctaccaggccagctgctgccgcccggcctcctgcgtgtccctcctctgccgccccgcgtgctcccccctggcctgctgaggcctctgctcaggccaggagtccagttgctgatgtgcacatcccccagggccaactggtcctgactcgggttaggaggttgcccccgcttgggacggggcccccatgtgctgaggtgacccccccctccatactcccaggaatctccatcctcgaagctccccagctcctgcctcccagcaggggcccacctgcctgttgggtcccctgtcctccctcccagcttctctgccccatgtcacttggcctcgacttgaacctgtcagcacctcctcctgctccccaataaactccccttggtcgcctga

SEQ ID NO: 145527 - DNA, 1238 bp, Homo sapiens
  Payload ID: 8801
  Gene Symbol: KRTAP10-6
  Gene Name: keratin associated protein 10-6
  Uniprot ID: P60371
  ENST ID: ENST00000400368
  CDS Start-End: 22-1119
ctccaccagttcaaccccagcatggccgcgtccaccatgtccgtctgctccagcgacctgagctacggcagccgcgtctgccttcctggttcctgtgactcttgctccgactcctggcaggtggacgactgcccagagagctgctgtgagcccccctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgtccgtctgctgtggggattcttcatgctgccagcagtctagctgccagtcagcttgctgcacctcctccccctgccagcaggcctgctgtgtgcccgtctgctgcaagcctgtctgctctgggatttcctcttcgtgctgccagcagtctagctgtgtgagctgtgtgtccagcccctgctgccaggcggtctgtgagcccagcccctgccaatcaggctgcaccagctcctgcacaccctcatgctgccagcagtctagctgccagccaacttgctgcacctcctccccctgccagcaggcctgctgcgtgcccgtctgctgcgtgcctgtgtgctgtgtgcccacctgctctgaggattcctcttcatgctgccagcagtctagctgccagccagcttgctgcacctcctccccctgccagcacgcctgctgtgtgcccgtctgctctggggcttccacatcatgctgccagcagtctagctgccagccggcttgctgcaccgcctcctgctgcagatcctcctcctccgtgtccctcctctgccaccctgtgtgcaagtccacctgctgcgtgcccgtcccctcctgtggtgcctctgcctcctcctgccagcccagctgctgccgcacggcctcctgtgtttccctcctctgccgccccatgtgctcccgccctgcctgctacagcctctgctctggccagaagtccagctgctgacagccctggatgtgatccggagtcccttcccaccaggggctgacctcccagctgccccagcaagctctgccctctctggctttgacaccctcagaagatggggcaggctctttgtctta

SEQ ID NO: 145528 - DNA, 790 bp, Homo sapiens
  Payload ID: 8801
  Gene Symbol: KRTAP10-6
  Gene Name: keratin associated protein 10-6
  ENST ID: ENST00000622352
  CDS Start-End: 30-764
agttcaaccccagcatggccgcgtccaccatgtccgtctgctccagcgacctgagctacggcagccgcgtctgccttcctggttcctgtgactcttgctccgactcctggcaggtggacgactgcccagagagctgctgtgagcccccctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgtccgtctgctgtggggattcttcatgctgccagcagtctagctgccagtcagcttgctgcacctcctccccctgccagcaggcctgctgtgtgcccgtctgctgcaagcccatctgctgtgtgcccgtctgctctggggcttccacttcatgctgccagcagtctagctgtcagccggcttgctgcaccacctcctgctgcagaccctcctcctccgtgtccctcctctgccgccccatatgcaggcccgcctgctgcctgcccatctcctcctgctgtgcccctgcctcctcctaccaggccagctgctgccgcccggcctcctgcgtgtccctcctctgccgccccgcgtgctcccccctggcctgctgaggcctctgctcaggccaggagtccag

SEQ ID NO: 145529 - DNA, 1578 bp, Homo sapiens
  Payload ID: 8802
  Gene Symbol: KRTAP10-7
  Gene Name: keratin associated protein 10-7
  Uniprot ID: P60409
  ENST ID: ENST00000609664
  CDS Start-End: 26-1138
catctcctccagttcaatccccagcatggctgcgtccactatgtctgtctgctccagcgacctgagctacggcagccgcgtctgccttcctggttcctgtgactcttgctccgactcctggcaggtggacgactgcccagagagctgctgcgagcccccctgctgcgccccggccccctgcctgagcctggtctgcaccccagtgagctatgtgtccagcccctgctgccgagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtactgtgtgcctgtctgcagtggggattcttcatgctgccagcagtctagctgccagtcagcttgctgcacctcctccccctgccagcaggcctgctgtgtgcccatctgctgcaagcctgtctgctctgggatttcctcttcgtgctgccagcagtctagctgtgtgagctgtgtgtccagtccctgctgccaggcggtctgtgagcccagcccctgccaatcaggctgcatcagctcctgcacgccctcgtgctgccagcagtctagctgcaagccggcttgctgcacctcctccccttgccagcaggcctgctgtgtgcctgtctgctgcaagcccgtctgctgtgtgcccacctgctctgatgattccggttcatgctgccagccagcttgctgcacctcctcccaaagccagcagggctgctgcgtgcccgtctgctgtaagcctgtgtgctgtgtgcccgtctgctctggggcttccacttcatgctgccagcagtctagctgccagccggcttgctgcaccacctcctgctgcagaccctcctcctccgtgtccctcctctgccgccccgtgtgcaggcccgcctgctgcgtgcccgtcccctcctgctgcgcccccacctcctcctgccaggccagctgctgccgcccagcctcctgtgtgtctctcctttgccgccccgcatgctcccgcccggcctgctgtggccccacctcaacccagaagtccagctgctgagtgatctccttaagatcatccaaagcctgagtgctcactgccacctgcacccctggattctttacccttgacggctctccacatcccgctcctaagccctgcagtggacgtcagtggtcagctggccatccagtgtgcgcttctcctcctagaagcagctcagctgtttctccaagtcttgactttcccccaattacccagccctgcttccccagcaacaggtgggcagtgaccccagcaaggccagcgggtgctcccaggccatagcccggtgtggggagaaatgagggtagacaggtaccaactgggtttctcgtcactgtcccagctcagtggcgagccctgctcctcccctgctgtgggcctgggcctctttctctgtcttccctgaccacgggagcaggtcagacccttctaataaactcctttcctaaaaagta

SEQ ID NO: 145530 - DNA, 794 bp, Homo sapiens
  Payload ID: 8802
  Gene Symbol: KRTAP10-7
  Gene Name: keratin associated protein 10-7
  ENST ID: ENST00000616689
  CDS Start-End: 31-768
agttcaatccccagcatggctgcgtccactatgtctgtctgctccagcgacctgagctacggcagccgcgtctgccttcctggttcctgtgactcttgctccgactcctggcaggtggacgactgcccagagagctgctgcgagcccccctgctgcgccccggccccctgcctgagcctggtctgcaccccagtgagctatgtgtccagcccctgctgccgagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgcccgtctgctctggggcttccacttcatgctgccagcagtctagctgccagtcagcttgctgcaccttctccccatgccaacaggcctgctgtgtgcccatctgctgcaagcccatctgctgtgtgcctgtctgctctggggcttcctctctgtgctgccagaagtctagctgccagccggcttgctgcaccacctcctgctgcagaccctcctcctccgtgtccctcctctgccgccctgtgtgccggcctgcctgctgtgtgcctgtcccctcctgttgtgtccctgcctcctcctgccagcccagctgctgccacccggcctcctgcctgtccttcctctgccgccccgcgtgctcccgcctggcctgctgaggcctctgctcaggccaggagtccag

SEQ ID NO: 145531 - DNA, 876 bp, Homo sapiens
  Payload ID: 8803
  Gene Symbol: KRTAP10-8
  Gene Name: keratin associated protein 10-8
  Uniprot ID: P60410
  ENST ID: ENST00000334662
  CDS Start-End: 23-802
accacccagtccagcacccaccatggctgacgcctgctgcaccaggacgtatgtgattgctgcatccaccatgtctgtctgctccagtgacgtgggccatgtcagccgagtctcctcccccagcacctgcactggctcctcctggcaggtggacaattgccaggaaagctgctgcgagccccgctcctgtgcctccagctgctgtacccctagctgctgtgccccagccccctgcctggccctggtctgtgccccagtgagctgtgagcccagcccctgccaatcaggctgcaccgactcctgcacaccttcatgctgccagcagtctagctgccagccggcttgctgcacctcctccccctgccaacaggcctgctgtgtgcctgtgtgctgcaagtccaactgctgcaagcccgtgtgctgcgtgtccatctgctctggagcttcctccccatgctgccagcagtctagctgccagtcagcttgctgcaccttctccccatgccaacaggcctgctgtgtgcccatctgctgcaagcccatctgctgtgtgcctgtctgctctggggcttcctctctgtgctgccagaagtctagctgccagccggcttgctgcaccacctcctgctgcagaccctcctcctccgtgtccctcctctgccgccctgtgtgccggcctgcctgctgtgtgcctgtcccctcctgttgtgtccctgcctcctcctgccagcccagctgctgccacccggcctcctgcctgtccttcctctgccgccccgcgtgctcccgcctggcctgctgaggcctctgctcaggccaggagtccagctgctgatgggcacgtcccccagggccagccggctccggtcctgtcct

SEQ ID NO: 145532 - DNA, 1171 bp, Homo sapiens
  Payload ID: 8804
  Gene Symbol: KRTAP10-9
  Gene Name: keratin associated protein 10-9
  Uniprot ID: P60411
  ENST ID: ENST00000397911
  CDS Start-End: 50-928
tcacacactcacttacacctcccccagctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccaggtgacctgtgagcccagcccctgccaatcaggctgcaccagctcctgcacgccctcgtgctgccagcagtctagctgccagccggcttactgcacctcctccccctgccagcaggcctgctgcgtgcccgtctgctgcaagcctgtgtgctgcgtgcccgtctgctgtggggcttcttcgtgctgccaacagtctagctaccagccagcttgctgtgcctcttcctcctgccagccggcctgctgtgtgcccgtctgctgcaaacctgtgtgctgtgcgcccacctgctctgaggattcctattcatgctgccaacagtctagctgccagccagcttgctgcacttcctccccctgccagcagtcctactgtgtgcctgtctgctgtaagcctgtctgctgcaaacccatctgctgtgtgcctgtctgctctggggcttcctctttgtgctgccagcagtctggctgccagccggcttgctgcaccacctcctgctgcagaccctcctcctctgtgtccctcctctgccgccctgtgtgcaggcccgcctgctgcgtgcccgtctcctcctgctgtgcccccacctcctcccgccagcccagctattgccgccaggcctcctgtgtgtcccttctctgccgccctgtgtgctcccgcccggcctgctacagcttctcctcaggccagaagtccagctgctgacggtcatgtcccccagggccagccgggctcaggccccacctccctgccagtccttggacctcccagcccacccagcctcagcacagctcaacacagaaggagcagccccagccacagccgcccagccccggggtctcagatgctcactggctcctccctgacctcccccccgggcaggcgagccctggcttctcctcacggtgcttcctggctgcagaccacaaccctccgctggtcgctggt

SEQ ID NO: 145533 - DNA, 615 bp, Homo sapiens
  Payload ID: 8804
  Gene Symbol: KRTAP10-9
  Gene Name: keratin associated protein 10-9
  ENST ID: ENST00000616529
  CDS Start-End: 25-603
agctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccaggtgacctgtgagcccagcccctgccaatcaggctgcaccagctcctgcacgccctcgtgctgccagcagtctagctgccagccggcttactgcacctcctccccctgccagcaggcctgctgcgtgcccgtctgctgcaagcctgtgtgctgcgtgcccgtctgctgtaagcctgtctgctgcaaacccatctgctgtgtgcctgtctgctctggggcttcctctttgtgctgccagcagtctggctgccagccggcttgctgcaccacctcctgctgcagaccctcctcctctgtgtccctcctctgccgccctgcctcctgtgtgtcccttctctgccgccctgtgtgctcccgcccggcctgctacagcttctcctcaggccagaagtccagctgctgacggtcatgtccc

SEQ ID NO: 145534 - DNA, 903 bp, Homo sapiens
  Payload ID: 8805
  Gene Symbol: KRTAP1-1
  Gene Name: keratin associated protein 1-1
  Uniprot ID: Q07627
  ENST ID: ENST00000306271
  CDS Start-End: 65-598
aataggcagccataattcagaaactcctccaagcaacccaaccttcagatcaactcctgacaccatggcctgctgtcagaccagcttctgtggatttcccagctgctccaccagtgggacctgcggctccagctgctgccagccaagctgctgtgagaccagctcctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatg

SEQ ID NO: 145535 - DNA, 903 bp, Homo sapiens; identical to SEQ ID NO: 145534
  Payload ID: 8805
  Gene Symbol: KRTAP1-1
  Gene Name: keratin associated protein 1-1
  Uniprot ID: Q07627
  ENST ID: ENST00000573871
  CDS Start-End: 65-598

SEQ ID NO: 145536 - DNA, 912 bp, Homo sapiens
  Payload ID: 8806
  Gene Symbol: KRTAP11-1
  Gene Name: keratin associated protein 11-1
  Uniprot ID: Q8IUC1
  ENST ID: ENST00000332378
  CDS Start-End: 32-523
gcaagctacctgcagccctctgtctgacatcatgtccttcaactgctccacaagaaattgctcttccaggcccattggaggacgctgcattgttccagtggcccaagttaccacgacttccaccactgatgctgactgcctgggcggcatctgtttgcccagttccttccagactggctcttggctcctggaccactgtcaagagacctgctgtgagcccactgcttgccagccaacctgttaccggcgaacttcatgtgtctccaacccttgccaggtgacttgctctcgacaaactacctgtatttccaacccctgctcaactacctacagccggccgctcacctttgtctctagtggatgtcagcccctgggaggcatctccagtgtctgccaaccagtgggcggcatctctactgtctgccaaccagtgggaggagtctctactgtctgccagccagcctgtggggtctccaggacgtatcagcagtcctgcgtgtccagctgccgaagaacctgctaagtgtgtaggagccagtgagcgaatcaagactccacgacctgccagctgtttccaggatcttccagcatgctgcttgtccctgaatagctcttcatagctgacccttcttgtgaccgcctgactgctggctactatccatgcacacgctgtctttagcactctaaaatttttctggccagccctaagcttgttttaagggttgctcactggtgctgtgtatgcctctggatgtgtccagaagctttaccatccacaccccagtctctgatgcttttgacatgttttcaccttgctgctgtatctcctggcctctgcttttgtgtctcacaaaaacagagcttgtctcaccatgtatttctcaataaacctgcattagttggcattgcaaa

SEQ ID NO: 145537 - DNA, 588 bp, Homo sapiens
  Payload ID: 8807
  Gene Symbol: KRTAP12-1
  Gene Name: keratin associated protein 12-1
  Uniprot ID: P59990
  ENST ID: ENST00000391617
  CDS Start-End: 41-331
cactgccctctgcctcgaccttatccagccacacgccaccatgtgccacaccagctgctcctcgggctgccagccagcctgctgcgcgcccagcccctgccaggcatcctgttacatccccgtgggctgccagtcctccgtgtgcgtgcccgtgagcttcaagccagccgtgtgtgtgcccgtgagatgccagtcctctgtgtgcgtgcccgtgagctgcaggcccgtcgtgtatgcggctccctcctgccagtcctctgggtgctgccagccttcctgcaccagcgtcctctgcagacccatctcctgcagcaccccttcctgctgctgagcatgaatctccagacccgctgctcccagtgcagatgaggccacacctgtacactccctggatgagtcctcagttggtcttctgcacatggtgcaggtgaaaagcatgctcagtgaaccctctgaattctggatcgagaatataatagaatgatctggagccctggctgaacttgcctatccccccagggaagtctggggtcccagagtcattctctgaccccatgagagtcaaataaaccagctttccccatgcaa

SEQ ID NO: 145538 - DNA, 739 bp, Homo sapiens
  Payload ID: 8808
  Gene Symbol: KRTAP12-2
  Gene Name: keratin associated protein 12-2
  Uniprot ID: P59991
  ENST ID: ENST00000360770
  CDS Start-End: 42-482
tcactgccctctgcctcgaccttatccagccacacgccaccatgtgtcataccagctgctcctcgggctgccagccagcctgctgcgcgcccagcccctgccagccagcctgttgtgtgcccagctcctgccaggcatcctgctgtgtgcctgtgggctgccagtcctccgtgtgtgtgcccgtgagcttcaagccagccgtgtgcctgcccgtgagctgccagtcttctgtgtgtgtgcccatgagcttcaagtcagctgtgtgcgtgcccgtgagctgccagtcttctgtgtgtgtgcctgtgagctgcaggcccattgtgtgtgcagccccctcctgccagtcctccctgtgcgtgcctgtgagctgcaggcctgtcgtgtatgcggctccgtcctgccagtcctctgggtgctgccagccctcctgcaccagcgtcctctgcagacccatctcctacagtatctcttcctgctgctgagcatgaatctccagacccgctgctcccagtgcagatgaggccacacctgtacactccctggatgagtcctcagttggtcttctgcacatggtgcaggtgaaaagcatgctcagttgaaccctctgaattctggattgagaatgtgacagaatgatctggagcccttgctgaccttgcccatccccccagggaagtctggggtcccagagtcattctctgaccccatgagagccaaataaaccagctttccccatgca

SEQ ID NO: 145539 - DNA, 410 bp, Homo sapiens
  Payload ID: 8809
  Gene Symbol: KRTAP12-3
  Gene Name: keratin associated protein 12-3
  Uniprot ID: P60328
  ENST ID: ENST00000397907
  CDS Start-End: 49-339
cagacatcaccatcctcctccccagtaccagcccagccacacgccaccatgtgccacaccagctgctccccagcctgccagccaacctgctgcatacacagcccctgccaggcatcctgctatgtgcccgtgagctgccagtcctccgtgtgcatgcccgtgagctgcacgcgcattgtgtgcgtggctccctcctgccagccctccgtgtgcgtgcccgtgagctgcaggcccatcatatatgtgactccctcttgccaatcttcggggtgctgccagcccccctgcaccactgccctctgcagacccatctcctgcagcaccccttcctgctgctgaccagctgctcctggtacacgggggtacacacctgtatccctccgtgaataagcatctggtggacccccaga

SEQ ID NO: 145540 - DNA, 441 bp, Homo sapiens
  Payload ID: 8809
  Gene Symbol: KRTAP12-3
  Gene Name: keratin associated protein 12-3
  ENST ID: ENST00000619249
  CDS Start-End: 1-441
tgccaatcaggctgcaccagctcctgcacgccgtcatgctgccagcagtctagctgccagccggcttgctgcacctcctccccctgccagcaggcctgctgtgtgcctgtctgctgcaagactgtctgctgcaagccttctagctgccagccagcttgctgtgcctcttcctcctgccagccggcctgctgtgtgcccgtctgctgcaagcctgcatcctgctatgtgcccgtgagctgccagtcctccgtgtgcatgcccgtgagctgcacgcgcattgtgtgcgtggctccctcctgccagccctccgtgtgcgtgcccgtgagctgcaggcccatcatatatgtgactccctcttgccaatcttcggggtgctgccagcccccctgcaccactgccctctgcagacccatctcctgcagcaccccttcctgctgctga

SEQ ID NO: 145541 - DNA, 447 bp, Homo sapiens
  Payload ID: 8810
  Gene Symbol: KRTAP12-4
  Gene Name: keratin associated protein 12-4
  Uniprot ID: P60329
  ENST ID: ENST00000391618
  CDS Start-End: 46-384
agaccagccctgtcctctgcgccccccacctgtccacactccatcatgtgccacaccagccactcttcgggctgcccaatggcctgccctggctccccgtgctgtgtccccagcacctgctacccacccgagggctatgggacctcctgctgctgctcagccccctgtgtggctctgctgtgccggcccctgtgtggggtatccacctgctgccagccagcctgctgtgtgcccagcccctgccaggtggcctgctgtgtgcctgtgagctgcaagcctgttttgtgtgtggcttccttctgcccaacctctgggtgctgccagcccttctgccccaccctggtctatagacctgtcacctggagcacccccactggctgctgagcaggtggcctcctatgaccctcgtaggtgcgaggtcagaagccagcaggctctctgaactcc

SEQ ID NO: 145542 - DNA, 972 bp, Homo sapiens
  Payload ID: 8811
  Gene Symbol: KRTAP1-3
  Gene Name: keratin associated protein 1-3
  Uniprot ID: Q8IUG1
  ENST ID: ENST00000344363
  CDS Start-End: 35-538
aagcaacccagacttcataccagctcccaacaccatgacctgctgccagaccagcttctgtggatatcccagctgctccaccagtgggacatgcggctccagctgctgccagccaagctgctgtgagaccagctgctgccagccaagctgctgccagaccagcttctgcggatttcctagcttctcaactagtgggacctgcagctccagttgctgccagccaagctgctgtgagaccagctgctgccagccaagctgctgccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgtgtggtgagctgcacacccccaacctgctgccagctgcaccacgccgaggcctcctgctgccgcccatcctactgtggacagtcctgctgccgcccagtctgctgctgctactcctgtgagcccacctgctaaaagccagtttgctgattttcaacttgaaatttccactttcagttccattcatgaacgaattatttcttcaagcacttatggacaacgaacaaattcttcaacctttctttgtctttcttatgggggttaccaaatattttggcctcagaattatctgattcctttcaattccagaaagaccttactcttctctctgaggacgccaaaatacaaatttgacccaagaaatgaaaaagccgatttaccttgaaactgagcctttgcaagcattgaagcccacgctctgagtctcagcgccgacgagaccatggaagagccatctgtccttctcaggacactcacttcctgtatcccaccgtcctgcaaattgcaccccctatgaaagaggaataatataccaaggtctaataaattttaactattggtgcaacaaa

SEQ ID NO: 145543 - DNA, 972 bp, Homo sapiens; identical to SEQ ID NO: 145542
  Payload ID: 8811
  Gene Symbol: KRTAP1-3
  Gene Name: keratin associated protein 1-3
  Uniprot ID: Q8IUG1
  ENST ID: ENST00000575715
  CDS Start-End: 35-538

SEQ ID NO: 145544 - DNA, 749 bp, Homo sapiens
  Payload ID: 8812
  Gene Symbol: KRTAP13-1
  Gene Name: keratin associated protein 13-1
  Uniprot ID: Q8IUC0
  ENST ID: ENST00000355459
  CDS Start-End: 14-532
atctcccatcaacatgtcctacaactgctgctctggaaacttctcctcccgctcctgtggtggctacctgcactacccagcctcctcctgtggcttttcctaccccagcaaccaggtctacagcactgacctctgctctcccagcacgtgccagctgggttcctctctctataggggctgtcagcagacctgctgggagcccaccagctgccagacatcctatgtggagtccagcccctgccagacctcctgctaccgtcccagaacctccttgctctgcagtccctgccagacaacttactctgggtctctaggctttggatccagcagctgccgctccctgggctatggatcgaggagctgctactcagtgggctgtgggtccagtggcttcagatccctgggttatggaggctgtggcttcccttccctgggctatggcgttggattctgccgcccaacctacttggcttctaggagctgccagtcttcttgctacagaccaacttgtggatcaggcttctactattgatcatcttgttaaattgctgattttgttggctaatgccttcaatgcctctactcataacctttattgtcttcatcatgtacagaaagaattagcctcttattctataattatcaagttctcagtttgtctttgtccccaaatactggctggcaggcttcatctgaaaaactgtaattggagaactagctcaaaataaatcttgaaatacacattaaaa

SEQ ID NO: 145545 - DNA, 867 bp, Homo sapiens
  Payload ID: 8813
  Gene Symbol: KRTAP13-2
  Gene Name: keratin associated protein 13-2
  Uniprot ID: Q52LG2
  ENST ID: ENST00000399889
  CDS Start-End: 45-572
aatctttccactataactcagctgaactcacatctcccgtcaacatgtcctacaactgctgctctggaaacttctcctcccgctcctgtggtgactacctgcgctacccagcatcctcacgtggcttttcctaccccagcaatctggtctacagcactgacctctgctctcccagcacctgccagctgggttcctctctctataggggctgtcaggagatctgctgggagcccaccagctgccagacgtcctatgtggagtccagcccctgccagacctcctgctaccgccccagaacctccttgctctgcagtccttgcaagacgacttactctgggtctctaggctttggatccagcagctgccgctccctgggctatggatcgaggagctgctactcagtgggctgtgggtccagtggtgtcagatccctgggttatggaagctgtggcttcccttccctcggctatggatctggattctgccgcccaacctacttggcttctaggagctgccagtctccttgttacagaccagcctatggatcaaccttctgcagatcaacttgctgaatttccagaccttttaagcaaagtgtctcagtctctacgtagagctgttatcataggcatttccagcaatgtgagctaacccctcttactactagctcttcatcctttctctggcatcaagtactggctggacaggctagttctttcagactgtgaaattaatgaatgagcaaaatatagagtcaaatgtctataattttgaaacaagtgattcgttatcacgtaagttcatcttataaagtatatggaagttcagttttgtttcacgtaataaattcatttactgttgattcca

SEQ ID NO: 145546 - DNA, 486 bp, Homo sapiens
  Payload ID: 8813
  Gene Symbol: KRTAP13-2
  Gene Name: keratin associated protein 13-2
  ENST ID: ENST00000613611
  CDS Start-End: 1-486
atgtcctacaactgttgctctagaaacttctcctcctgctcccacgggggttacttgcactacccaggctcctcctaccccagcaatctggtctacagcactgacctctgctctcccagcacctgccagctgggttcctctctctataggggctgtcaggagatctgctgggagcccaccagctgccagacctcctgctaccgccccagaagctccgtgctctgcagtccctgccagtcgacttactctgagtctctaggctttggatccagcagctgccgctccctgggctatggatctaggagctgctactcagtgggccgtgggtccagtggcgtcagatccctgggttatggaggctgtggcttcccttccctgggctatggatctggattctgccacccaacatatgttctctttaggacattccagtcttcctgttacagaccaacttgtggatctggcttctaccgatcaacttgctaa

SEQ ID NO: 145547 - DNA, 704 bp, Homo sapiens
  Payload ID: 8814
  Gene Symbol: KRTAP13-3
  Gene Name: keratin associated protein 13-3
  Uniprot ID: Q3SY46
  ENST ID: ENST00000390690
  CDS Start-End: 57-575
ttaaaactcagaatcttcccaggtacactcagctgaactcacatcttcccgtcaacatgtcctacaactgttgctctagaaacttctcctcctgctcccacgggggttacttgcactacccaggctcctcctgtggctcttcctaccccagcaacctggtctacagcactgacctctgctctcccagcacctgccagctgggttcctctctctataggggctgtcaggagacctgctggaggcccaacagctgtcagacattgtgtgttgagtccagcccctgccacacctcctgctactaccccaggactcacatgctctgcaattcttgcctgactatgcatgttgggtctcggggttttggatccaatagctgctgctccctgagctgtggatccaggagctgctcctcactgggctgtggatccaatggcttcagatatctgaattatagaatccatacctccccttcccagagttatagatccagattctgccatccaatctattttccacctagaaggtggttccattcatcttgttatcagccattctgtagatctggtttctactgactaatgtggtgactggtaaaactcatttgagaaatgcatattctttagtaaggtcatctgttaatttcttcctttgagaagtattctaatattattgatcaccaggtcttccttactttccagccctca

SEQ ID NO: 145548 - DNA, 797 bp, Homo sapiens
  Payload ID: 8815
  Gene Symbol: KRTAP13-4
  Gene Name: keratin associated protein 13-4
  Uniprot ID: Q3LI77
  ENST ID: ENST00000334068
  CDS Start-End: 47-529
agaatcttcttaggtacactcagctgaactcccatctctcatcagcatgtcctacaactgctgctctagaaacttctcctcccgctcctttgggggctacctgtactacccaggctcctaccccagcagcctggtctacagcactgccctctgctctcccagcacctgccagctgcgttcctctctctacagggactgtcagaagacctgctgggagcccgccagctgccagaaatcctgctaccgccccaggacctccatcctctgctgtccctgtcagacgacttgctctggatctctaggctttcggtccagcagctgtcgctcccagggctatggatctaggtgctgctactcgctgggaaatggatccagtggcttcagattcctgaaatatggaggctgtggttttccttccctgagttacggatccagattctgctacccaaactacttggcttctggagcctggcagtcttcttgttacagaccaatctgtggatctcgcttctatcaattcacctgctaaatttctagatccttttgagtattgggatcaaagtctctactgaatgcagccattattttcattcttgccagatcccaatatctttttattcttccaccaccagcttcttgcatgaccaacttctggcagactgcgaaattaatgagtaacctaatattaacttctaatatctttaccattgatcgaatatatgctatctgattttcatccaaaaactgttgaaaatggaaattttaatctaataaatgtatgtaatctggtacccaaa

SEQ ID NO: 145549 - DNA, 408 bp, Homo sapiens
  Payload ID: 8816
  Gene Symbol: KRTAP1-4
  Gene Name: keratin associated protein 1-4
  Uniprot ID: P0C5Y4
  ENST ID: ENST00000377747
  CDS Start-End: 27-392
cagctctcaacccaactcctgacaccatggccagctgttccaccagtgggacctgtggctccagctgctgccagccaagctgctgtgaaactagctgctgccagccaagctgctgccagaccagctcctgcggaaccggctgtggcattggtggtggcattggctatggccaggagggcagcggtggatctgtgagcacccgtatcaggtggtgccacccagattgccacgtggagggcacctgcctgcccccctgctacctggtaagctgcacacccccatcctgctgccagctgcaccacgccgaggcctcctgctgccgcccgtcctactgtggacagtcctgctgccgcccagcctgctgctgccactgctgtgagcccacctgctaaaagccaggttgctgat

SEQ ID NO: 145550 - DNA, 408 bp, Homo sapiens; identical to SEQ ID NO: 145549
  Payload ID: 8816
  Gene Symbol: KRTAP1-4
  Gene Name: keratin associated protein 1-4
  Uniprot ID: P0C5Y4
  ENST ID: ENST00000576814
  CDS Start-End: 27-392

SEQ ID NO: 145551 - DNA, 1177 bp, Homo sapiens
  Payload ID: 8817
  Gene Symbol: KRTAP1-5
  Gene Name: keratin associated protein 1-5
  Uniprot ID: Q9BYS1
  ENST ID: ENST00000361883
  CDS Start-End: 48-572
cagaaactcctccaagcaacctaactcttaacccaacttctgacaccatgacctgctgccagaccagcttctgtggatatcccagcttctccatcagtgggacctgtggctccagctgctgccagccaagctgctgtgagaccagctgctgccagccacgcagctgccagactagcttctgcggatttcccagcttctcaaccagtgggacctgcagctccagttgctgccagccaagctgctgtgagaccagctgctgccagccaagctgctgtgagaccagctgctgccagccaagctgctgccagatcagctcctgcggaactggctgtggcattggtggtggcatcagctatggccaggagggcagcagtggagctgtgagcacccgtatcaggtggtgccgcccagacagtcgtgtggagggcacctacctacccccctgctgtgtggtgagctgcacgcccccatcctgctgccaactgcaccatgcccaggcctcctgctgccgcccgtcctactgtggacagtcctgctgccgcccagtctgctgctgtgagcccacttgctgaaagccagtttgcttattttcaattgcctaggtcacagtgtctctgaactgttcatcccttgaccacctctggaccactaacaagttctcagactttgcattgcttgtgatggagactactaagtatatgagctcacaattctatctgattccattctacaatgaataccttgacccttcactggggacacagaaatgctacaaagccacctgctgatcatcaatttgcttgggatatactatttctgatatttctgcaggattaaaaattactgacatgttgtggaatttatccatgagaactatccacaagtctaatgtttccatgctttataatctattttatcttgtttacctaaaattttttgcaacatcaaagacaccaaattatagccaagtgacattcctcaagtcaccagagagaatggaagctcatcacccaacattcagcttctaagaagtaggctggactttccacattttaacatctgatccatcccttggtttttggatcataatgatcttgcctgctggatatttcagttatatctgtgatacaatgtcttctgtcatttcttaataaatattatatactaggcaaagaaa

SEQ ID NO: 145552 - DNA, 1177 bp, Homo sapiens; identical to SEQ ID NO: 145551
  Payload ID: 8817
  Gene Symbol: KRTAP1-5
  Gene Name: keratin associated protein 1-5
  Uniprot ID: Q9BYS1
  ENST ID: ENST00000572212
  CDS Start-End: 48-572

SEQ ID NO: 145553 - DNA, 671 bp, Homo sapiens
  Payload ID: 8818
  Gene Symbol: KRTAP15-1
  Gene Name: keratin associated protein 15-1
  Uniprot ID: Q3LI76
  ENST ID: ENST00000334067
  CDS Start-End: 54-467
cacacacacacgctcctcactgcaaatcacctgagctcagaactcctgttaacatgtcttacaactgcagctctggaaacttctcctcctgctgttttggaagttacctgaggtatccagtttccacttataatttgttctaccccagcaatgccatctattctccaaatacctgccaactgggctcctctctctacaatggctgtcaggagacctactgtgagcccaccagctgccagacatcctgcactttggccagatcctatcagacatcctgttactgcccaaagaattccatcttctgcagtccccgccagactaactacataagatcccttggatgtggaaacactggccttggatctcttggttgtggaagcactggcttccaatctctggactgtgggtccagcttctaccacccaactaccttttcatccaggaatttccaggcaacttgttactaaccagcctttgggtctcgcctttttggatcatcttactgaatattctccattctctcatgattatttctgtactctatggaactgcaacactcagcctgtccaatatctgtgattgttgaccatctacatcagtaggactcagcatcctagccctcttggaagtatatgattgaacacggacaaattaatcttgacctaggaccc

SEQ ID NO: 145554 - DNA, 1554 bp, Homo sapiens
  Payload ID: 8819
  Gene Symbol: KRTAP16-1
  Gene Name: keratin associated protein 16-1
  Uniprot ID: A8MUX0
  ENST ID: ENST00000391352
  CDS Start-End: 1-1554
atgtctggcagttgctcttctaggaaatgcttctccgtgccagccacctctctctgctccactgaggtgagctgtggaggccccatctgcctgcccagttcctgccagagccagacatggcagctggtgacttgtcaagacagctgtggatcatccagctgtgggccacagtgccgtcagccctcctgtcctgtgagtagctgtgcccaacccctgtgctgtgatcctgtcatttgtgagccttcttgctccgtgagcagcggctgccaacccgtgtgctgtgaggccaccacctgtgagccttcttgctctgtgagcaactgctaccaacctgtgtgcttcgaggccaccatctgtgagccttcttgctcagtgagcaactgctgccaacctgtgtgctttgaggccaccgtttgtgagccttcttgttccgtgagcagctgtgctcaacctgtgtgctgtgagcctgctatttgtgagccttcttgctccgtgagcagctgctgccagcctgtaggctctgaagccacttcctgccaaccagtcctctgtgtgcccacttcctgccagcctgtcctctgcaaatccagctgctgccagccagttgtctgtgagcccagctgctgttcagctgtctgcaccctgcctagttcctgccaacctgtggtctgtgagccttcctgctgtcagccggtgtgcccgacacctacctgctctgtgaccagtagctgccaggctgtctgctgtgaccccagcccttgtgagccaagttgctcagagtctagcatctgccagccagctacgtgtgtggctctggtctgtgagccagtttgcctccgccctgtctgctgtgttcagagctcgtgcgagccaccttctgtccccagcacttgccaagagccttcttgttgtgtctccagtatctgccaacccatctgctctgagcccagcccctgctcaccagctgtctgtgtgtccagtccatgccaacctacttgctatgtagtcaagcgctgtccttctgtctgccctgagccagtttcctgcccatctacctcctgccgacctctttcctgcagtccagggtcttctgcatctgccatctgccgaccaacttgtcctaggactttctacatacccagttccagcaaacggccttgcagtgctacgatttcctaccgcccggtctcccgtccgatctgccgcccaatctgctctggactcctcacctataggcagccatacatgacatccatctcctaccgtcctgcctgctatcgcccatgctactccatcctgcgccgcccagcctgtgtcacttcctactcttgccgcccagtctacttccgcccatcttgcactgagtctgactcttgcaaacgggattgcaaaaaatccacttccagccaactggattgtgttgacacaaccccctgcaaggtggatgtctcagaagaggctccctgccagcccactgaagccaaacccatcagcccaaccacccgtgaggccgcagcagctcagcctgctgccagcaagcctgccaactgctaa

SEQ ID NO: 145555 - DNA, 1554 bp, Homo sapiens; identical to SEQ ID NO: 145554
  Payload ID: 8819
  Gene Symbol: KRTAP16-1
  Gene Name: keratin associated protein 16-1
  Uniprot ID: A8MUX0
  ENST ID: ENST00000572734
  CDS Start-End: 1-1554

SEQ ID NO: 145556 - DNA, 779 bp, Homo sapiens
  Payload ID: 8820
  Gene Symbol: KRTAP17-1
  Gene Name: keratin associated protein 17-1
  Uniprot ID: Q9BYP8
  ENST ID: ENST00000334202
  CDS Start-End: 46-363
gaactccggctgcgttaccgacctgcgagctgacgggcccggaccatggggtgctgcccgggggactgcttcacctgctgcacccaggagcaaaactgctgtgaagagtgctgctgtcagccgggctgctgtggctgctgcggctcctgctgtggctgtgggggctctggctgcgggggctctggctgcgggggcagctgctgcggatcgtcttgctgtggatctggctgcggaggctgtggaggctgcggaggctgcgggggtggctgctgtggatccagttgctgtgggtccagttgctgcggctccgggtgctgtgggcctgtgtgctgccagcccacacctatatgcgacacaaaatgaagacctttccctccaccactgatgcagtcccaccgaaagcctccatctgctccagggggacagcccctcgtgtccagaaccttccatacccccaagacagtgtcttgtctttctgtgatttgtagaggagggcttgttctccaacaccttctctggtatttcaaggcaccgagaacaagagccatactctgatgaaacattaaaactcggtcacaactaagtgatcccaagctcaagggtgaatccccaatactttacttattcacatgaagttcaatgtcttgtactataagacatcctcttcttcaaggtgtctttgggactgatcctccgccctggctttctgcagctttgagatgcaaaaaaggtccatcttctttgtgagcctcttaataaatttgagcatgctggcataa

SEQ ID NO: 145557 - DNA, 779 bp, Homo sapiens; identical to SEQ ID NO: 145556
  Payload ID: 8820
  Gene Symbol: KRTAP17-1
  Gene Name: keratin associated protein 17-1
  Uniprot ID: Q9BYP8
  ENST ID: ENST00000574858
  CDS Start-End: 46-363

SEQ ID NO: 145558 - DNA, 646 bp, Homo sapiens
  Payload ID: 8821
  Gene Symbol: KRTAP19-1
  Gene Name: keratin associated protein 19-1
  Uniprot ID: Q8IUB9
  ENST ID: ENST00000390689
  CDS Start-End: 28-300
acaaaccaactcaccactcctgacaccatgagtcactacggcagctactacggaggcctgggctacagctgtggaggcttcggtggcctgggctatggctatggctgtggatgtggcagcttctgcagacggggttctggctgtggctatggaggctacggatatggctctggctttggaagctacggatatggctctggctttggaggctacggatatggctctggctttggaggctatggatatggctgctgccgcccatcgtacaatggaggatacggattctctggcttttattaaatgaattgctgaaattggaagcagaggagaaacctccaaatgtgtttggtcctgtcccgtgctttcattccaaaaatccattctattgccttcagcatcaatggagagatatttagctatgttaaatctttaaaatagatttaagctgcttctgtgaatatttgttgtctttttactttcggagtccgtcacctgaaatcatattcatgtataactactctaggttgttcttctaaatttgctttatttttcttaccaccattaccttgatgttatctatcaagatcctagcaaaaacttgtattttgcttttatctaataaatgaagtaaagtataaatatttta

SEQ ID NO: 145559 - DNA, 380 bp, Homo sapiens
  Payload ID: 8822
  Gene Symbol: KRTAP19-2
  Gene Name: keratin associated protein 19-2
  Uniprot ID: Q3LHN2
  ENST ID: ENST00000334055
  CDS Start-End: 89-247
gcaaacccaactcactatctctgacaccgtgagctactagggcagctactgtggaggtctgggctatggctgtggaggctttggtggcatgtgctatggctacggctgtggatgtggcagcttctgcagactgggctatggctgcggctatgaaggatgcagatatggttgtggccacagaggctgtggagatggctgctgctgcccatcatgctacagaagatatagattcactggcttctactaagctgctgctctagtgatgcagcatctgttattttgaagggatttaaaaacaagttacttacttctaagatacaatgggggtaaaggtgtaaatgtgtaaatgctcccattccaaagggagaaattgaccaaaa

SEQ ID NO: 145560 - DNA, 522 bp, Homo sapiens
  Payload ID: 8823
  Gene Symbol: KRTAP19-3
  Gene Name: keratin associated protein 19-3
  Uniprot ID: Q7Z4W3
  ENST ID: ENST00000334063
  CDS Start-End: 29-274
gcaaaccaaactcactacccctgacaccatgagctactacggcagctactatggaggcctgggctatggctgtggaggctttggtggcctgggctatggctatggctgtggatgtggcagcttccgcagactgggttctggctgtggctatggaggctacggatatggctctggctttggaggctatggatatggctctggcttcggaggctacggatatggctgctaccgcccatcatactatggaggatatggattctctggattctattaaactactgccccagcaacacaatgtgtgaaattataagaggactttcccagagctgacttcaatcattggacaacaaagatcatgctggagctatttgcacaaaagaatttaacatctcagaatttcaggcaattttttttctctgtatacccacatctctataataatcctagtattctctacttttgcttttaaagctgattgaattatctgtttatcttccaataaaacattctattttcaaacac

SEQ ID NO: 145561 - DNA, 216 bp, Homo sapiens
  Payload ID: 8823
  Gene Symbol: KRTAP19-3
  Gene Name: keratin associated protein 19-3
  ENST ID: ENST00000620117
  CDS Start-End: 1-216
atgagctactacggcagctactatggaggcctgggctatggctgtggaggctttggtggcctgggctatggctatggctgtggatgtggcagcttccgcagactgggttctggctgtggctatggaggctacggatatggctctggctttggaggctatggatatggctgctgccgcccatcgtacaatggaggatacggattctctggcttttat

SEQ ID NO: 145562 - DNA, 310 bp, Homo sapiens
  Payload ID: 8824
  Gene Symbol: KRTAP19-4
  Gene Name: keratin associated protein 19-4
  Uniprot ID: Q3LI73
  ENST ID: ENST00000334058
  CDS Start-End: 24-278
aacaactcaccactcctgacgccatgagctactatggcagctattacagaggcctgggctatggctgtggaggctttggtggcctaggctatggctatggctgtggatgtggcagcttccgcagactgggttatggctgtggctttggaggcaacggatatggctactgccgcccatcatgctatggaggatatggattctcaattctactgaaatcctaccctgaggacacgatatcagaggtcataagaagatcattcaatttaaccaaatattgagtcaaacaagggcacactagatcaatccaaga

SEQ ID NO: 145563 - DNA, 461 bp, Homo sapiens
  Payload ID: 8825
  Gene Symbol: KRTAP19-5
  Gene Name: keratin associated protein 19-5
  Uniprot ID: Q3LI72
  ENST ID: ENST00000334151
  CDS Start-End: 28-246
gcataccaactcaccactcctgacaccatgaactactacggcaactactatggaggcctgggctacggctacggaggcttcgatgacctgggctatggctatggctgtggatgtggcagcttccgcagactgggctatggcggtggctacggaggctacggatacggctctggcttcggaggctatggataccgcagctgccgtccatcatgctatggaggatatggattctctggattttattgaaatccttccctgacaacctaacatgaggggacataagaagatcacccaaacctgactgcaataacaaacaaacgaggtcaccctggatcaagccaagatcaagagcagttagcatctaagaggtttaagaatacctatcattccataattctttgctttatgtctctggatgtgtcttacttgtacctttataactgtggggtttctctgttcct

SEQ ID NO: 145564 - DNA, 330 bp, Homo sapiens
  Payload ID: 8826
  Gene Symbol: KRTAP19-6
  Gene Name: keratin associated protein 19-6
  Uniprot ID: Q3LI70
  ENST ID: ENST00000334046
  CDS Start-End: 32-208
gcattgaactgaatctctagtccctgacaccatgagatactatggcagctactacagaggcctgggatatggctgtggaggctttggtggtctgggctatggctgtggctgtggaggctacagatatggctctggctatggaggctatagatatggctgctgccgcccatcatgccgtgaaggatatggattctctggattctactaaaaaacttgctgattctcatactctaactccaagatcttgcccgtatgcttcagcaaggcgaacacttttctcaatgtagagaaaatacctaccattttttggcttcatgctccagaaggaac

SEQ ID NO: 145565 - DNA, 440 bp, Homo sapiens
  Payload ID: 8827
  Gene Symbol: KRTAP19-7
  Gene Name: keratin associated protein 19-7
  Uniprot ID: Q3SYF9
  ENST ID: ENST00000334849
  CDS Start-End: 26-217
acaacagctaaccacttctgacaacatgagctactccggcagctactatggaggcctaggctacggctgtggaggattcggtggcctgggctatggctatagctgtggatgtggcagcttccgcagactgggctatggctgtggctatggaggctacagatacagctgctgccacccatcatgctatgggggatactggtcttctggattctattgaataaatacttgaaatatagtcttctgtgagattcccaattcttccaagaaactttattccataaccatatggaattccatattccataacaaaacagctgcttggatcacctgccttttgacaatagtgtgaagaaaacttgatcaactagatattggcatttgattagtgatgttctccagatattcacttttttattggctggagagccattatactctaa

SEQ ID NO: 145566 - DNA, 216 bp, Homo sapiens
  Payload ID: 8827
  Gene Symbol: KRTAP19-7
  Gene Name: keratin associated protein 19-7
  ENST ID: ENST00000614763
  CDS Start-End: 1-216
atgagctactccggcagctactatggaggcctaggctacggctgtggaggattcggtggcctgggctatggctatagctgtggatgtggcagcttccgcagactgggctatggctgtggctatggaggctacagatatggctctggctatggaggctatagatatggctgctgccgcccatcatgccgtgaaggatatggattctctggattctac

SEQ ID NO: 145567 - DNA, 318 bp, Homo sapiens
  Payload ID: 8828
  Gene Symbol: KRTAP19-8
  Gene Name: keratin associated protein 19-8
  Uniprot ID: Q3LI54
  ENST ID: ENST00000382822
  CDS Start-End: 34-225
ttgacctccaaacacatctacagttgctgaaccatgagctactacagaagctattatggaggcctgggctatggctatggaggctttggtggctggggctatggctatggctgcggctatggcagcttccgcaggttgggctatggctgtggctacggaggctatggattcagctgttgccgaccattatactacggaggatatggattctctgccttctactgaagagtgaactcattctttggatcactagaatctgtctatcatcctgacttaattctcctttcaggtctttttaccccctctgtgaattgcgca

SEQ ID NO: 145568 - DNA, 275 bp, Homo sapiens
  Payload ID: 8829
  Gene Symbol: KRTAP20-1
  Gene Name: keratin associated protein 20-1
  Uniprot ID: Q3LI63
  ENST ID: ENST00000334664
  CDS Start-End: 31-201
tctacacctgaaccatccatttctgacaccatgatttactacagcaactattatggtggctatgggtatggtgggcttggctgtggctatggctgtggttatcgtggctatggatgtggttatggtggctatggaggctatggaaatggctactactgcccatcttgctatggaagatattggtcatatggtttctactgaacaattctagagctcaccagatttgtctgcttgtgaaacctggattctcatgctgctcttgttcatctgatcct

SEQ ID NO: 145569 - DNA, 384 bp, Homo sapiens
  Payload ID: 8830
  Gene Symbol: KRTAP20-2
  Gene Name: keratin associated protein 20-2
  Uniprot ID: Q3LI61
  ENST ID: ENST00000330798
  CDS Start-End: 29-226
ctcaaccaaatcctccactcttgaaaccatgtgctactacagcaactactatggtggtctgcgttatggctatggagtcctgggcggtggctatggctgtggctgtggttatggccatggctatggaggcctgggctgtggctatggccgtggctatggtggctatggatatggctgctgccgcccatcttgctatggaagatactggtcctgtggcttctactgagaaatatctggcaactcaacctcgtggtctcttccacatggacttcctaaatttgccttcataattcttcatatgagtaattcatttttctgttgtaaaatgtcaacatcatccttaagtatctggaagaaaaaataggtcagatgctgcaagcctca

SEQ ID NO: 145570 - DNA, 273 bp, Homo sapiens
  Payload ID: 8831
  Gene Symbol: KRTAP20-3
  Gene Name: keratin associated protein 20-3
  Uniprot ID: Q3LI60
  ENST ID: ENST00000382826
  CDS Start-End: 26-160
ggctagagacttaaatcctgacacaatgagctactatggcaactactacggaggactgggctatggctatgactgtaaatatagttatacctctggctttggtgcctttagaatcctggactgtggctacagatgtggctgtggtggggtatggatttgactgctgccaccaatatgattatgctacatgcttattatcaggcactgactgaataatatctacaattgggtccattttcttatgagacaggggtgctgttctactacactttt

SEQ ID NO: 145571 - DNA, 224 bp, Homo sapiens
  Payload ID: 8832
  Gene Symbol: KRTAP20-4
  Gene Name: keratin associated protein 20-4
  Uniprot ID: Q3LI62
  ENST ID: ENST00000382828
  CDS Start-End: 32-166
tccacaactgaaacatccacttctgaacaccatgtcctactacagccatctttctggtggcctgggctgcggcttggctgtggctgtgactatgggaaggactgtggctgtggctgagtatggcaggtgcagacatggctgccactcatcttactctgccaggtaatgacaccatggattccactgaggaacacctagagcagttcagtctactgcactcctcc

SEQ ID NO: 145572 - DNA, 776 bp, Homo sapiens
  Payload ID: 8833
  Gene Symbol: KRTAP2-1
  Gene Name: keratin associated protein 2-1
  Uniprot ID: Q9BYU5
  ENST ID: ENST00000391419
  CDS Start-End: 50-436
catccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagtgcactgactgcccggaacgcgtaactcaccttctgaaaaagtcacactcccatttctctactttaacaaacctcctgccctgagcccacaaaaccccacatcaaccaagcagggaaccgagcactgggctcatctattaagacctgggccattctgaagtctgtaaaagaagcaatttccttcttcttaagatttcgtggcatgtttattttctaataaatatctgttctttggccttgcaaaaa

SEQ ID NO: 145573 - DNA, 375 bp, Homo sapiens
  Payload ID: 8833
  Gene Symbol: KRTAP2-1
  Gene Name: keratin associated protein 2-1
  ENST ID: ENST00000542137
  CDS Start-End: 1-375
atgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctcctgtgtctgtgcagtccccctgcggccagccgaccccttgcagcaccacctgcaggacctcctcctgctga

SEQ ID NO: 145574 - DNA, 776 bp, Homo sapiens; identical to SEQ ID NO: 145572
  Payload ID: 8833
  Gene Symbol: KRTAP2-1
  Gene Name: keratin associated protein 2-1
  Uniprot ID: Q9BYU5
  ENST ID: ENST00000571136
  CDS Start-End: 50-436

SEQ ID NO: 145575 - DNA, 375 bp, Homo sapiens; identical to SEQ ID NO: 145573
  Payload ID: 8833
  Gene Symbol: KRTAP2-1
  Gene Name: keratin associated protein 2-1
  ENST ID: ENST00000617413
  CDS Start-End: 1-375

SEQ ID NO: 145576 - DNA, 599 bp, Homo sapiens
  Payload ID: 8834
  Gene Symbol: KRTAP21-1
  Gene Name: keratin associated protein 21-1
  Uniprot ID: Q3LI58
  ENST ID: ENST00000335093
  CDS Start-End: 51-290
cctcagaagcatcttcttgaaacccatctcaattctctcctcttgacaacatgtgttgcaactactacggcaactcctgtggctatggctccggctgtggctgtggctatggctctggctctggctgtggctgtggctatggaactggctatggctgtgggtatggctgtgggtttggctcccattatggctgtggttatggaactggctatggctgtggatatggctctggctctggctactgtggctaccggccattttgctttagaagatgctattcttcctgctaaaacatcactgtcggaggaccatttgcttctaaaatgacacgtctgaagataatgctgattcaaggattcgtactccaagatttctatatccaagaattacatgcttgacagaatcttcgacctctagcctcacatttctttgaatgaaatcatggccataggatccatggtgtcatctgactgttttccaaatgttatcttttgctcccttaatctctgattctctgttatgactgtgttaatgatcataacatctacagttgcggaagtcaatcatttgtaataaaaatggttctttattcctaaaaa

SEQ ID NO: 145577 - DNA, 440 bp, Homo sapiens
  Payload ID: 8835
  Gene Symbol: KRTAP21-2
  Gene Name: keratin associated protein 21-2
  Uniprot ID: Q3LI59
  ENST ID: ENST00000333892
  CDS Start-End: 32-283
cacctcaactgaaatctaacctcctgaaatcatgtgttgcaactactacagaaactgctgtgggggctgtggatatggctctggctggagttccggctgtggatatggttgtggctatggctgtggatacggctctggctgtagatatggctctggctatggaactggctgtggctatggctgtggatacggctctggctgtggatatggctgtggatacagctctagctgctgtggctaccgaccactttgctacagaagatgctattcctcttgctactaatcatcactacaggtcatccttggctttgcaatgacctctccaagatcaagttcaattgaaatctcccctacccattatcttcacatctaagtaaaggttgactatggtcacctgactatctgaatgcatataagagaagctgttggcagtggatgga

SEQ ID NO: 145578 - DNA, 253 bp, Homo sapiens
  Payload ID: 8836
  Gene Symbol: KRTAP21-3
  Gene Name: keratin associated protein 21-3
  Uniprot ID: Q3LHN1
  ENST ID: ENST00000444335
  CDS Start-End: 19-195
ttctcatctcctgacactatgtatttcaattacaaaagtgtgtgtgggagctgtggatttggctcttgctatggttgtgggtatggctgtatacacagcacccactgtggctgtaacggttattatggttgttatgaaaataaatattctgttatagatgatctgatattttttgcttctaagaaatgccattgagcattgtttcttatttagtttctcaaagatctgttctgctttaatcaccttcaatcct

SEQ ID NO: 145579 - DNA, 733 bp, Homo sapiens
  Payload ID: 8837
  Gene Symbol: KRTAP2-2
  Gene Name: keratin associated protein 2-2
  Uniprot ID: Q9BYT5
  ENST ID: ENST00000398477
  CDS Start-End: 20-391
accagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagcccgttatcacgaagggcccctcagaagatggccaggtccatcccgctgcccctcagggcttcaccgcagagcaatacacgtttccttgagaagcccatttctcatctcttcatactagctcacactatgcattgaagacaccttttcagaccaaccacagatgagaaatacttttcctaggactccagtctaactcctatatcatgttgtctgctttctaataaactcaatactcctaccatagaaa

SEQ ID NO: 145580 - DNA, 390 bp, Homo sapiens
  Payload ID: 8837
  Gene Symbol: KRTAP2-2
  Gene Name: keratin associated protein 2-2
  ENST ID: ENST00000542910
  CDS Start-End: 1-390
atgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgcggccagccgtccccctgcggccagccgaccccttgcagcaccacctgcaggacctcctcctgctga

SEQ ID NO: 145581 - DNA, 863 bp, Homo sapiens
  Payload ID: 8837
  Gene Symbol: KRTAP2-2
  Gene Name: keratin associated protein 2-2
  ENST ID: ENST00000573155
  CDS Start-End: 49-435
atccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagcccgttatcacgaagggcccctcagaagatggccaggtccatcccgctgcccctcagggcttcaccgcagagcaatacacgtttccttgagaagcccatttctcatctcttcatactagctcacactatgcattgaagacaccttttcagaccaaccacagatgagaaatacttttcctaggactccagtctaactcctatatcatgttgtctgctttctaataaactcaatactcctaccata

SEQ ID NO: 145582 - DNA, 714 bp, Homo sapiens
  Payload ID: 8837
  Gene Symbol: KRTAP2-2
  Gene Name: keratin associated protein 2-2
  ENST ID: ENST00000614687
  CDS Start-End: 1-372
atgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagcccgttatcacgaagggcccctcagaagatggccaggtccatcccgctgcccctcagggcttcaccgcagagcaatacacgtttccttgagaagcccatttctcatctcttcatactagctcacactatgcattgaagacaccttttcagaccaaccacagatgagaaatacttttcctaggactccagtctaactcctatatcatgttgtctgctttctaataaactcaatactcctaccatagaaa

SEQ ID NO: 145583 - DNA, 296 bp, Homo sapiens
  Payload ID: 8838
  Gene Symbol: KRTAP22-1
  Gene Name: keratin associated protein 22-1
  Uniprot ID: Q3MIV0
  ENST ID: ENST00000334680
  CDS Start-End: 35-181
ctgctatacaactgagcctacctttcttgaaaccatgagctttgataacaactaccatggtggccagggctatgccaaaggaggcctgggctgcagctatggctgtggtcttagcggctatggctatgcctgctactgcccatggtgttatgaaagatcttggttttctggctgcttctgagaaattagagattgctgatctgtttaggccattctcttatgagctatgttttcttcccgtgtttttttctgttcaaagagtgacaactaaaatttagcccacattgccaagtcag

SEQ ID NO: 145584 - DNA, 293 bp, Homo sapiens
  Payload ID: 8839
  Gene Symbol: KRTAP22-2
  Gene Name: keratin associated protein 22-2
  Uniprot ID: Q3LI68
  ENST ID: ENST00000382830
  CDS Start-End: 24-161
attgaactccatcttctgacaccatgtgctactaccacaactattatggtagcctggactatggttgcagctatggctctgaatatggtaactctggatatgcctgcaactttccgtgctcctatggaagattcctattggctcctagaaagaaattctgattgctgatcactttgagccattttcttgtgatgcactaattgcatcaacagggttatttatggattcgttattgtctctccaattttaactaactctaattattgattaccacaggtcatatttgcattgga

SEQ ID NO: 145585 - DNA, 875 bp, Homo sapiens
  Payload ID: 8840
  Gene Symbol: KRTAP2-3
  Gene Name: keratin associated protein 2-3
  Uniprot ID: P0C7H8
  ENST ID: ENST00000391418
  CDS Start-End: 65-451
attcacacctgagaacatccagctcctctcaacagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcctccctgcggccagccgaccccttgcagcaccacctgcaggacctcctcctgctgagaccccacctctcctctcaacgcacgaaacattcccaggtgcacagaagcttgtgcagactcttctaccccttctggatcagatgagagactccacctttgcagcctagctgatcctcaagcacgaattcaacaataacatcctatctatttccccacataattatgcagctaatcctggccctctctgacaatcttgagaaaaattccagctttcatcattcgaattcctggcttgaaaaaaaaaacgagtaaataaaaatcaaagctcctcttgaatagaactctgtcccactgactcatcacccttttttctactgtttcaaggttctcagatgagatttttttcttccaggataatactatttgtatgctgtatttttgcactgtaaaaaaaaataaaattatatttctggggaagcaaa

SEQ ID NO: 145586 - DNA, 875 bp, Homo sapiens; identical to SEQ ID NO: 145585
  Payload ID: 8840
  Gene Symbol: KRTAP2-3
  Gene Name: keratin associated protein 2-3
  Uniprot ID: P0C7H8
  ENST ID: ENST00000570303
  CDS Start-End: 65-451

SEQ ID NO: 145587 - DNA, 211 bp, Homo sapiens
  Payload ID: 8841
  Gene Symbol: KRTAP23-1
  Gene Name: keratin associated protein 23-1
  Uniprot ID: A1A580
  ENST ID: ENST00000334160
  CDS Start-End: 4-201
aacatgtcctacaactgctgctgtggaaacttctcctcccattcctgtgagggctacctgtgctactcaggctactcccgtggtggctcctcgtaccccagcaacctggtctacagcactgaacctttgatctcccagcacctgccagctgggttcctctctctgcaagggctttcaggagacttgctgggaaacccctagctgccagatg

SEQ ID NO: 145588 - DNA, 764 bp, Homo sapiens
  Payload ID: 8842
  Gene Symbol: KRTAP2-4
  Gene Name: keratin associated protein 2-4
  Uniprot ID: Q9BYR9
  ENST ID: ENST00000394015
  CDS Start-End: 35-421
aatagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagaccccaatgcccccacagagcaatacactgaagcctaaacatctatctggtgtttttaaaaagttaaaagaaaaatagattttttttcacaaggtgacaatagtgatttttaccatctggatacagcctggtgtaagcagacgtccattaccaccctcacccacattttcaggtgtctacatcagccttagtcattatggatagtaaatcgacctttaagaattcctggggtggactttgcaaacacattctacaacctgatggtttttactgctcaaactgtcaccatcatcttttgcaatgtgttgctcactgttgtcaataaactaatttttcctggca

SEQ ID NO: 145589 - DNA, 764 bp, Homo sapiens; identical to SEQ ID NO: 145588
  Payload ID: 8842
  Gene Symbol: KRTAP2-4
  Gene Name: keratin associated protein 2-4
  Uniprot ID: Q9BYR9
  ENST ID: ENST00000572903
  CDS Start-End: 35-421

SEQ ID NO: 145590 - DNA, 1650 bp, Homo sapiens
  Payload ID: 8843
  Gene Symbol: KRTAP24-1
  Gene Name: keratin associated protein 24-1
  Uniprot ID: Q3LI83
  ENST ID: ENST00000340345
  CDS Start-End: 27-791
gacacactgcacagcgaccactgagcatgcctgcaggctccatgtctactacaggctatcctggggtctgcagtaccacatcatacagaactcactgttatatcccagtgacctcttctgttactcttagctccagtgatttaagccctacctttggacactgcttacccagtagctaccaaggaaatctctggctcctggattactgccaagaatcctacggtgaagcaccaacctgcaaatctcccagctgtgagcccaagacctgcagtaccactggttgtgacccgtcaaactcctctgtgccctgcaactccccatcagcaggccaagtcttcagtgtctgtgaaactaccaacgtcagccccagccccagctgcagcccaagcacccagaccaatgggtatgtatgcaattgccacatacccactcgaaatgcatccaaagcctgccaaaccctccgcaacggttccaactgctttggacaacttaactgcttatccaagagtttccaaactctaaaccactgcagattgagtactttggggtataaaagctaccaaaatccttgcttcatacccagctacgtctcaccattatgttatatttccaacagctgccaaccccaaagctatttagtgagaaattatcactattcaagctacaggcctacgagctgccgaccactgagctatttatctagaagcttcagatctctgagctatatacccagtacctttccacctctgaggtatttgtgcagtggtagcagacctctgaaatgctattgaccaacttccagaatttatagcagctggaaattgcccaatggggaagattctactaagtactagaacgtctaattttctgctgaatctctttattcagcctaagaatcttgttacattaagttcaaatacaactcccaggtttattaaccacagccagtatcacctgctaggttttcttttttctgttgttctgttattgctctttgtactaaaagctgaccctgaaggtaacatcattatttctgagatttattacaatggacttaccgaagagactccatttgaaatacaaccatcaccggctttcttactttggctgtcactgtcacttgtctgacagtgtgattatcacctacctttcctgatgaaatggggcctccatggtttgactgcagattccagcatgcaaattcattcggatggctttgattgtcattaatatttttgtcaactacctaactagcaccttgctaataagccgatagaaaacactatcttgagcataataagttgaactatttcatccttttcttactgattgattgtaagaacaggcaaatagcaatggtgactagagctcaaaaatagaagacttcagcaaatcttctcttccagagaagccataaaacaagattcactggtactcagcttttgttctccatgcctaagaaaaagcctcagaattagctaaagcatgaaaattatttgttgaaagaagaacaaatactgttagagaccctttacaattatgtgtaatctgcgtttaggattctcctatcatcttgccttgccaatttattgcattctgactctggaaaatgtcctagttcttagttaataaacaaatttctgtctggaa

SEQ ID NO: 145591 - DNA, 370 bp, Homo sapiens
  Payload ID: 8844
  Gene Symbol: KRTAP25-1
  Gene Name: keratin associated protein 25-1
  Uniprot ID: Q3LHN0
  ENST ID: ENST00000416044
  CDS Start-End: 25-333
ttctcaagttcctgccaatcctcaatgcataacagatctcaaggcttttttttcagtagttgccacccccaaaaccatgtctcttatggctgtcaatcaccgagctttattttttgtcgctgtcaatcactgaattttgtgtccaggacctgctatcccttgagctatttctcctatggtaatcaaactataggttctatatccaacagcttcagatccctgaattatgtgtctcatagtttccaacctatttccttcatgcacagcagtttccaaccagcttgttctgattttgtgggttggcaatctccatttcttagaagaacatgctgaattgtcttttcagtgtcttgccctgacagcgttttac

SEQ ID NO: 145592 - DNA, 1193 bp, Homo sapiens
  Payload ID: 8845
  Gene Symbol: KRTAP26-1
  Gene Name: keratin associated protein 26-1
  Uniprot ID: Q6PEX3
  ENST ID: ENST00000360542
  CDS Start-End: 282-914
aagaaggatagatcctattaaaactcagtcgcattggtttatagatagacgtaatcaatggatggcattgcaaggagcatccagttttatggagggtggaagcctcacttccttggctataataaagagttctgatgcatcttcatacaacaagaggaagagtctgcacgcagaagcaccaccttctagggataaataaagggtcaagctaaggaagggcagaacaaacttcagacactcacttctttgcctcaacttcagcctgctctcacaacctcactatgtcttgccccaactactgctcgggaaactccaactcaggatctctcagaacctcccgccatattcctctcacctccatcgacctctgccctaccagcgtgagctgtggagatgtcctctacttacccactagctctcaagaccatacctgggtcacagacaactgccaagagacctgcggtgaaccaaccagctgccagccggtccactgtgagaccggcaatcttgaaacctcttgcggttcttccactgcttactacgtgcccaggccttgccaaggaagcagttttcttcctgcttctttcttctccagttcctgccttccagtatcctgtagaccacagaggtatgtgtccagcggctgtcgtccactgaggccgctgctcaatagttaccagcccataggagactgtgtgcccaatgcctatcgcccccaattctgcttgtccaagagttgccagccccaaaacctcctcacttctggatgccaaccctcgagttgcttggcctatcgtcctcaaagtcttcacgttgtgtccagcagcctcagacctctggggcctctgttcagtggttgccaacctctgacccatgtgttcagcacgtgtcgtccatcttgctctggactgtgaaaccagcagcttctttgttccagtgaataatcactctgagcatccacaacaaaaattcaaactccatggacttttgcttctttgctagtagcaactgatgtttcttagttttactgtgcctgatctaatgcaagctgcttctctcgcatgttttatcttgttttcatctttccttgacatcaaaaaaattagtttacaatgctattcaatgttgctctggtctgggaagaatgtatttgttttgcactataataaatgcgattaagtccaaattaagaa

SEQ ID NO: 145593 - DNA, 682 bp, Homo sapiens
  Payload ID: 8846
  Gene Symbol: KRTAP27-1
  Gene Name: keratin associated protein 27-1
  Uniprot ID: Q3LI81
  ENST ID: ENST00000382835
  CDS Start-End: 27-650
gaccatctttaaggatttttagcaatatgcctcatagccactgccattcactcaggagcttccacaatgccccaccactctctgccatcacacatggcactaatcctataacctttgaagacagattgtgtttgcccagcagcttccatagcagaacctgtttcctggacaactttcaagaaacctgcaatgaaaccaccagctgccaaatgaccaattgtgaacaggacttattcacagacgatagctgtgtgcaaagtaactgcttccccggagttgtccaaactacttactccaattccaggccctgcgaaaggacagcgtgccaatcagaaagttcttcagcagggctggcttgtgtttctcagccttgccaatcagaaagcactcagcagatgggttttgtagcccagagctgccaacctgcaagcctcaagggaaacagttgcccacccaagacttctaagtctaaaaatttcgaaactctggaacgtgcatctagccaatgtcagtgtcagtctcagaaccctgaatccagttcctgtagacctctggtcaatgttgcacctgagccacaactcctggaatcttctccaggagttgaaccaacttgctgtgttactggtggttctcaattgcctagtaagtgaagatctgtaggggagatggcttatattctcat

SEQ ID NO: 145594 - DNA, 1026 bp, Homo sapiens
  Payload ID: 8847
  Gene Symbol: KRTAP29-1
  Gene Name: keratin associated protein 29-1
  Uniprot ID: A8MX34
  ENST ID: ENST00000391353
  CDS Start-End: 1-1026
atggcagacggctgttgtcctggaaacaccacagccattccagctgtgcccaccatcaccacatacccagttaaaggtggatttcgacatgctctctgtttgcctagttcctgccacagcagaatgtggcaactggtcacatgccaagaaagctgtcagccatccattggtgccccaagtggctgtgatcctgcttcgtgtcaacctacccgccttccagcaacgtcttgtgtgggttttgtttgccaacctatgtgctcccacgcagcctgctatcagtctggcactggtcagtctccttgtctggttagctcatgtcagccatcctgctcggaatctacttgttgtcaggaaaagtgctgcgatgccagtccctgccagcaaagctcctgccaggaatctgtctgcatgtctggatcatgtcaggcagcttgtggccaatcagtctgctgtgatgctggatcctgccagccatcctgctctgaagtgacctcctgtccggaaacttcttgcctaccaaccatctgtacagctagtccatgccaaccaacttggtgccaaggaagttcatgtcaacccgtcagtggtgaaggccagccctgtaaatcaacttattatcaacccatctgctatattttcaagccttgccaatcagccctctacatgcctgttccctgccagccatcgacttgtgtgttcagttcttgcaatactacttgctgtgtgccttcccattgccagccacctcactgccaactggttccttccacatgcttcatctaccagccagtggctaactgccaggccccttgttccacaaagaactgttgcaaaccagcttcttgtgacactgtgatttctggccaaccaacttgtgatggacccccttcctataaccagagtggctgcaaatcagcttgctgtgtgactggtttaggcacatcacccagtagtggctccaattgcttgccgacttcatgccaacccagctgtgagtccagcttctgcaaggcaacactttgttaa

SEQ ID NO: 145595 - DNA, 1026 bp, Homo sapiens; identical to SEQ ID NO: 145594
  Payload ID: 8847
  Gene Symbol: KRTAP29-1
  Gene Name: keratin associated protein 29-1
  Uniprot ID: A8MX34
  ENST ID: ENST00000576125
  CDS Start-End: 1-1026

SEQ ID NO: 145596 - DNA, 1026 bp, Homo sapiens; identical to SEQ ID NO: 145594
  Payload ID: 8847
  Gene Symbol: KRTAP29-1
  Gene Name: keratin associated protein 29-1
  Uniprot ID: A8MX34
  ENST ID: ENST00000574737
  CDS Start-End: 1-1026

SEQ ID NO: 145597 - DNA, 594 bp, Homo sapiens
  Payload ID: 8848
  Gene Symbol: KRTAP3-1
  Gene Name: keratin associated protein 3-1
  Uniprot ID: Q9BYR8
  ENST ID: ENST00000391588
  CDS Start-End: 41-337
agacttctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccatctgctgtgacacctgccccccaccctgctgcaagcctgatacctatgtgccaacttgctggctgctcaacaactgtcacccgactcccggactgagtgggatcaacctgaccacctatgttcagcctggctgtgagagtccctgtgagccccgctgttaaccagccgagtctgcacaggttccgtgaggtggctgcccaatgtcctctgcaccatctgggcttcagcactcactactgcctacatcaaggctaaggccatcccaatccccggggccaagtcttgatgaatcttcttaattatttgcacatttgggtaccattggagacctcccttctgtcttttaggctatttcatcactctttgagaaataaccattttgaccatttgttaataaactttattctggcttagcaaa

SEQ ID NO: 145598 - DNA, 594 bp, Homo sapiens; identical to SEQ ID NO: 145597
  Payload ID: 8848
  Gene Symbol: KRTAP3-1
  Gene Name: keratin associated protein 3-1
  Uniprot ID: Q9BYR8
  ENST ID: ENST00000571440
  CDS Start-End: 41-337

SEQ ID NO: 145599 - DNA, 702 bp, Homo sapiens
  Payload ID: 8849
  Gene Symbol: KRTAP3-2
  Gene Name: keratin associated protein 3-2
  Uniprot ID: Q9BYR7
  ENST ID: ENST00000391587
  CDS Start-End: 42-338
cctcatctaagaaactgaaagctaaccagacgcccattgccatggattgctgtgcctctcgcagctgcagtgtccccactgggcctgccaccaccatctgctcctccgacaaatcctgccgctgtggagtctgcctgcccagcacctgcccacacacagtttggttactggagcccatctgctgtgacaactgtcccccaccctgccacattcctcagccctgcgtgcccacctgcttcctgctcaactcctgccagccaactccgggcctggagaccctcaacctcaccaccttcactcagccctgctgtgagccctgcctcccaagaggctgctgatggatggctactttgctcagtgcccgacaacgaagaatccagaagctgtcccttcagtattcacttgcctcagtagtttgccagatgttaaggtagaccagatgacccagatatgaagaacttacctttggttttaatgggggaaaaaaagaaaagtattttttatggttatttagctgaaaaaccatttggttcctgtgggcaggtgaatgagttttattagcaaaatactgtttcaatctttaagacctcagattacatgttcttgatcatattgcttcctggctcttgtttcttgtactgggtattttcatagaagaaaatttcttggtgggttttccaataaactatatttctctggcaa

SEQ ID NO: 145600 - DNA, 702 bp, Homo sapiens; identical to SEQ ID NO: 145599
  Payload ID: 8849
  Gene Symbol: KRTAP3-2
  Gene Name: keratin associated protein 3-2
  Uniprot ID: Q9BYR7
  ENST ID: ENST00000575409
  CDS Start-End: 42-338

SEQ ID NO: 145601 - DNA, 704 bp, Homo sapiens
  Payload ID: 8850
  Gene Symbol: KRTAP3-3
  Gene Name: keratin associated protein 3-3
  Uniprot ID: Q9BYR6
  ENST ID: ENST00000391586
  CDS Start-End: 37-333
caatcaaacccataaataccacagactctaatagccatggattgctgtgcctctcgaggctgcagtgtccccaccgggcctgccaccaccatctgctcctctgacaaatcctgccgctgtggagtctgcctgcccagcacctgcccacacacagtttggttactggagcccacctgctgtgacaactgtcccccaccctgccacattcctcagccctgcgtgcccacctgcttcctgctcaactcctgccagccaactccaggcctggagaccctcaacctcaccaccttcactcagccctgctgtgagccctgcctcccaagaggctgctaatggatggctactttgctcagtgcctgagattgaaaaagtcaacatagaagctttagcattcacctatctcagtacctacaactaatgtactctgctttagaaattggaacaaggatggtactaccacaatcaccccctgcaaaaaaaaagagaccaagaaactttcaatgaccattcagctataaccaactgcagtttgaatcagtggatgcctatagcttcctgaagctgttcgattccttcatattaaagtgtctctttctgtgggtggtttgggaattctgttttcagtcttgggtggtatctttctgaaaattaaggaagttcttcatgattatcctaataaattttacatctctggcatagcacaa

SEQ ID NO: 145602 - DNA, 704 bp, Homo sapiens; identical to SEQ ID NO: 145601
  Payload ID: 8850
  Gene Symbol: KRTAP3-3
  Gene Name: keratin associated protein 3-3
  Uniprot ID: Q9BYR6
  ENST ID: ENST00000572132
  CDS Start-End: 37-333

SEQ ID NO: 145603 - DNA, 1241 bp, Homo sapiens
  Payload ID: 8851
  Gene Symbol: KRTAP4-1
  Gene Name: keratin associated protein 4-1
  Uniprot ID: Q9BYQ7
  ENST ID: ENST00000398472
  CDS Start-End: 489-929
atttctgctgttttcttctagttgtttcacagtttatttttctcagaagaatcttcagaaaacaagaaacatcatcccatttgaggactgctgtgagacacacagttttcaggatgacacacagaatgctgagttccaagtgatctgtcacctgacaatcgactggatgagtaagattacaagtctttgaaattaaatgacacactaaattaactgaagacaagaggaggaggaaagactggattggctaaactctaacacagagaaagaataaaagtgcattccaccttttatacagatattttcccacaattagctaacttgataattgcctatctattaagataaacaataacaaggaaatagcttttatgtggtgacaacagctcctcagctgagtataaaagtggacatgggataaggagattcccacattcgaaaaactcactgtcttggaaacctacctagaacctccaccctctgacaccatggttaactcttgttgtggctctgtctgctctgaccagggctgtgatcaaggcctctgccaagagacctgctgccgccccagctgctgccagaccacctgttgctgccccagctgtgttgtatccagctgctgccgcccatcctgctctcagactacctgctgccagaccacttgctgtcgccccagctgctgccacccagtctgttgtcagaccacctgccgccccagctgtggtgtgtccagctgctgccgcccactctgctgtcagaccacctgccaccccagctgtggtatgtccagctgctgccgtccactctgttgtcagaccacctgccgccccagctgtggtgtgtccagctgctgccgtccactctgctgtcagaccacctgctgccgtgcaacttgctgccgccccagctgctgtggatcctcttgttgaacctcatattggactatcaaccatgagccagtcaccatcccatgatatgaaagtgtcatttatatcaacttgtccatgtgttaaatggccatcagctttattatcctgttattccactaagtaactggtgaaagggcatccatctacatttaataccactcatttttcccatggatctcttcccagcagcattcagacctcagatgcatgatgcagttagactaagcctctaagtttctgactgttatgcttgatttgaccttcaaaattacatattaactgttcttcaataaatattatcttaatatcagt

SEQ ID NO: 145604 - DNA, 737 bp, Homo sapiens
  Payload ID: 8851
  Gene Symbol: KRTAP4-1
  Gene Name: keratin associated protein 4-1
  ENST ID: ENST00000620667
  CDS Start-End: 42-425
ctgtcttggaaacctacctagaacctccaccctctgacaccatggttaactcttgttgtggctctgtctgctctgaccagggctgtgatcaaggcctctgccaagagacctgctgccgccccagctgctgccagaccacctgttgctgccccagctgtgttgtatccagctgctgccgcccatcctgctctcagactacctgctgccagaccacttgctgtcgccccagctgctgccacccagtctgttgtcagaccacctgccgccccagctgtggtgtgtccagctgctgccgtccactctgttgtcagaccacctgccgccccagctgtggtgtgtccagctgctgccgtccactctgctgtcagaccacctgctgccgtgcaacttgctgccgccccagctgctgtggatcctcttgttgaacctcatattggactatcaaccatgagccagtcaccatcccatgatatgaaagtgtcatttatatcaacttgtccatgtgttaaatggccatcagctttattatcctgttattccactaagtaactggtgaaagggcatccatctacatttaataccactcatttttcccatggatctcttcccagcagcattcagacctcagatgcatgatgcagttagactaagcctctaagtttctgactgttatgcttgatttgaccttcaaaattacatattaactgttcttcaataaatattatcttaatatcagt

SEQ ID NO: 145605 - DNA, 1180 bp, Homo sapiens
  Payload ID: 8852
  Gene Symbol: KRTAP4-11
  Gene Name: keratin associated protein 4-11
  Uniprot ID: Q9BYQ6
  ENST ID: ENST00000391413
  CDS Start-End: 46-633
ttcactctcctagaaacccaactagatccttcaccctctgacaccatggtaaactcctgttgtggctccgtgtgctctcaccaaggctgtggccgagacctctgccaggagacctgctgccgccccagctgctgtgagaccacctgctgcaggaccacctactgtcgccccagctgctgtgtgtccagctgctgcaggccccagtgctgccagtctgtgtgctgccagcccacctgctgccgccccagatgctgcatctccagctgctgtcgccccagctgctgtgtgtccagctgctgcaagccccagtgctgccagtctatgtgctgccagcccacttgctgccgccccagatgctgcatctccagctgctgtcgccccagctgctgtgtgtccagctgctgcagaccccagtgctgccagtctgtgtgctgccagcccacctgctgccaccccagctgcagcatctccagctgctgccgcccctcttgctgtgaatccagctgctgccgcccctgctgctgcctgcgtccagtctgtggccgagtctcctgccacaccacttgctatcgcccaacctgtgtcatctccagctgcccccgccccttgtgctgtgcctcctcttgctgctgagcccactgccctggctcatctctcccttcactgcaggcccacagttgtagaccattcttctgtgctgactattaggacacatggagtgggattgatgtcattcagcagggtggacttcatgtttccaatgagcccatcaccatcccactgactctgtgagaacattctggttcattttaaactccctcccttgctttctttctcttccagtcatggcaccaaatatgaaataatttgtaatccactagctaagaaattattccaatcctctaaattcctcattttttaaatcgttttgagcctacagaatatccttcccagtgaggtacacattatctccatttcaaacatattatttgtctgtcagcctttcagtcattcttttctcttggaaaggtaggaggctgcccctcccatgctctcctgctttctccctgttctctctttgtctctgtttgttcaagtttgccagaatttttctattttattggttctttatctttattgtgttcacaaaatatattgtattaaacttttcatttagaaa

SEQ ID NO: 145606 - DNA, 1180 bp, Homo sapiens
  Payload ID: 8852
  Gene Symbol: KRTAP4-11
  Gene Name: keratin associated protein 4-11
  Uniprot ID: Q9BYQ6
  ENST ID: ENST00000573418
  CDS Start-End: 46-633
ttcactctcctagaaacccaactagatccttcaccctctgacaccatggtaaactcctgttgtggctccgtgtgctctcaccaaggctgtggccaagacctctgccaggagacctgctgccgccccagctgctgtgagaccacctgctgcaggaccacctactgtcgccccagctgctgtgtgtccagctgctgcaggccccagtgctgccagtctgtgtgctgccagcccacctgctgccgccccagatgctgcatctccagctgctgtcgccccagctgctgtgtgtccagctgctgcaagccccagtgctgccagtctatgtgctgccagcccacttgctgccgccccagatgctgcatctccagctgctgtcgccccagctgctgtgtgtccagctgctgcagaccccagtgctgccagtctgtgtgctgccagcccacctgctgccaccccagctgcagcatctccagctgctgccgcccctcttgctgtgaatccagctgctgccgcccctgctgctgcctgcgtccagtctgtggcggagtctcctgccacaccacttgctatcgcccaacctgtgtcatctccagctgcccccgccccttgtgctgtgcctcctcttgctgctgagcccactgccctggctcatctctcccttcactgcaggcccacagttgtagaccattcttctgtgctgactattaggacacatggagtgggattgatgtcattcagcagggtggacttcatgtttccaatgagcccatcaccatcccactgactctgtgagaacattctggttcattttaaactccctcccttgctttctttctcttccagtcatggcaccaaatatgaaataatttgtaatccactagctaagaaattattccaatcctctaaattcctcattttttaaatcgttttgagcctacagaatatccttcccagtgaggtacacattatctccatttcaaacatattatttgtctgtcagcctttcagtcattcttttctcttggaaaggtaggaggctgcccctcccatgctctcctgctttctccctgttctctctttgtctctgtttgttcaagtttgccagaatttttctattttattggttctttatctttattgtgttcacaaaatatattgtattaaacttttcatttagaaa

SEQ ID NO: 145607 - DNA, 705 bp, Homo sapiens
  Payload ID: 8852
  Gene Symbol: KRTAP4-11
  Gene Name: keratin associated protein 4-11
  ENST ID: ENST00000613957
  CDS Start-End: 27-659
accgagaacctccaccctctgacaccatggtcaactcctgttgtggctctgtgtgctctgaccagggctgtggcccagtctgctgtcagcccacctgctgccgccccagctgctgtcagaccacctgctgtaggaccacctgctgccgccccagctgctgtgtgtccagctgctgcagaccccagtgctgccagtctgtgtgctgccagcccacctgctgccgccccagctgctgtcagaccacctgctgccgccccagatgctgcatctccagctgctgtcgccccagctgctgtgtgtccagctgctgcaagccccagtgctgccagtctatgtgctgccagcccacttgctgccgccccagatgctgcatctccagctgctgtcgccccagctgctgtgtgtccagctgctgcagaccccagtgctgccagtctgtgtgctgccagcccacctgctgccaccccagctgcagcatctccagctgctgccgcccctcttgctgtgaatccagctgctgccgcccctgctgctgccgcccctgctgctgcgtgcgtccagtctgtggccgagtctcctgccacaccacttgctatcgcccaacctgtgtcatctccacctgtccccgccccgtgtgctgcgcctcctcttgctgctgagcccactgccctggctcatctctcccttcgccgctggtccacaaat

SEQ ID NO: 145608 - DNA, 1077 bp, Homo sapiens
  Payload ID: 8853
  Gene Symbol: KRTAP4-12
  Gene Name: keratin associated protein 4-12
  Uniprot ID: Q9BQ66
  ENST ID: ENST00000394014
  CDS Start-End: 46-651
ctcactctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtccagctgctgcaggccccagtgctgccagtctgtgtgctgtcagcccacctgctgccgccccagctgctgtcagaccacctgctgtaggaccacctgctgccgccccagctgctgtgtgtccagctgctgcagaccccagtgctgccagtctgtgtgctgccagcccacctgctgccgccccagctgctgtcagaccacctgctgcaggaccacttgctgccgccccagctgctgtgtgtccagctgctgcagaccccagtgctgccagtctgtgtgctgccagcccacctgctgccgccccagctgctgcatctccagcagctgctgcccctcttgctgtgaatccagctgctgccgcccctgctgctgcctgcgtccagtctgtggccgagtctcctgccacaccacttgctatcgcccaacctgtgtcatctccacctgcccccgccccttgtgctgtgcctcctcttgctgctaaatctctgctgtgaacacaccacttccttattacgtcctttcctacagatgaaggctctcattgcaaacatgcggactgttcaagagaattgatctgggtcccataagcaaacctcatccttagaaattctgtatttgcattctaccttttgtccaaactcccttccttccaaaggaattcattgacaatctcctaataaattgacaaattgtcctccaacatcctcccacctctttgacttcaggacatttattcatcatgcctaaggaatttgaagattgcctccatcatttgtagggccacagatcttaaagcctccaaccttgaagtccagtgaagtctctctcttaaagtcttttgcaaacatttttgtaccttgttatttccatgtaccaaaataaacctctattctattggcactgaaaa

SEQ ID NO: 145609 - DNA, 1077 bp, Homo sapiens; identical to SEQ ID NO: 145608
  Payload ID: 8853
  Gene Symbol: KRTAP4-12
  Gene Name: keratin associated protein 4-12
  Uniprot ID: Q9BQ66
  ENST ID: ENST00000571271
  CDS Start-End: 46-651

SEQ ID NO: 145610 - DNA, 708 bp, Homo sapiens
  Payload ID: 8854
  Gene Symbol: KRTAP4-16P
  Gene Name: keratin associated protein 4-16, pseudogene
  ENST ID: ENST00000440582
  CDS Start-End: 1-708
atgtgcagttcaaagatgccatgcagccccagtgcttccagtctgtgtgctgccagcccacccaactgctgtcaccccagctgttgtcagaccacctgctgcagaaccacctcctgctcccacagctgctctgtgtccagctgctgcagaccccagtgctgccattccgtgtgctgccagcccacctgctgccgccccagctgctgtcagaccacctgctgcaggacgacctgctgccaccccagctgctgtgtgtccagctgctgcagaccccagtgctgccattccgtgtgcttccagcccacctgctgccaccccagctgctgcatctccagcagctgctgcccctcttgctgtgaatcgagctgctgctgcccctgctgctgcctgcgtccagtctgtggtcgagtctcctgccacgtcacttgctatcacccaacctgtgtcatctccacctgcccccaccccttgtgctgtgcctcccctccccttcccctccccttcccttccccacccgttcccctccctttcttcctttcccttgccctcccctcccctccccgcccttcccctcccctcctctccccagtgttaatcccctccccttccccttccccttctctcccttcactttcccctcccctcccctcccctcccctcccctcccctcatttccccagtgttaatcccaagagcatgcttcaataa

SEQ ID NO: 145611 - DNA, 708 bp, Homo sapiens
  Payload ID: 8854
  Gene Symbol: KRTAP4-16P
  Gene Name: keratin associated protein 4-16, pseudogene
  ENST ID: ENST00000576939
  CDS Start-End: 1-708
atgtgcagttcaaagatgccatgcagccccagtgcttccagtctgtgtgctgccagcccacccaactgctgtcaccccagctgttgtcagaccacctgctgcagaaccacctcctgctcccacagctgctctgtgtccagctgctgcagaccccagtgctgccattccgtgtgctgccagcccacctgctgccgccccagctgctgtcagaccacctgctgcaggacgacctgctgccaccccagctgctgtgtgtccagctgctgcagaccccagtgctgccattccgtgtgcttccagcccacctgctgccaccccagctgctgcatctccagcagctgctgcccctcttgctgtgaatcgagctgctgctgcccctgctgctgcctgcgtccagtctgtggtcgagtctcctgccacgtcacttgctatcatccaacctgtgtcatctccacctgcccccaccccttgtgctgtgcctcccctccccttcccctccccttcccttccccacccgttcccctccctttcttcctttcccttgccctcccctcccctccccgcccttcccctcccctcctctccccagtgttaatcccctccccttccccttccccttctctcccttcactttcccctcccctcccctcccctcccctcccctcccctcatttccccagtgttaatcccaagagcatgcttcaataa

SEQ ID NO: 145612 - DNA, 763 bp, Homo sapiens
  Payload ID: 8855
  Gene Symbol: KRTAP4-2
  Gene Name: keratin associated protein 4-2
  Uniprot ID: Q9BYR5
  ENST ID: ENST00000377726
  CDS Start-End: 45-455
ccaccttcctggaaatccacccagaacctccaccctctgacaccatggtcaactcctgttgtggctctgtgtgctctgaccagggctgtggcctagagaactgctgccgtcccagctgctgccagaccacctgctgcaggaccacctgctgccgccccagctgctgtgtgtccagctgctgcagaccgcagtgctgccagtctgtgtgctgccagcccacctgctgcagccccagctgctgccagaccacttgctgcaggaccacctgctgccgtcccagctgctgtgtgtccagctgcttcagaccccagtgctgccagtctgtgtactgccagcccacctgctgccgccccagctgtggccagaccacctgctgcaggaccacctgctaccgccccagctgctgtgtgtccacctgctgccgcccaacctgctctagtggctcttgctgctgatgccctcacctatactcacctgcctttattaaccagcattcttgatatgatccacctgtgaactgaatcatgcaaggccaattggacaacctcagttccaaccaattcttggattgagtttggcctccaaatatgctcaccaaacactatgttgctaccctctaccaaatgaatacaagtttgaattttctctgaaatatgtcaaccccatgttccctgaattgaaatatttgctctctaccataatttatcacatggagctattcctctatcttaaataaattttaatttttgaggcatacaaataa

SEQ ID NO: 145613 - DNA, 964 bp, Homo sapiens
  Payload ID: 8856
  Gene Symbol: KRTAP4-3
  Gene Name: keratin associated protein 4-3
  Uniprot ID: Q9BYR4
  ENST ID: ENST00000391356
  CDS Start-End: 23-610
agaacctccaccctctgacgccatggtcagctcctgctgtggctctgtctgctctgaccagagctgtggtcaaggtctcggccaggagagctgctgccgccccagctgctgccagaccacctgctgcaggaccacctgctgccgccccagctgctgcatttccagttgctgcaggccttcctgctgtatctccagctgctgcaaacccagctgctgcaggaccacctgctgccgccccagctgctgcatttccagttgctgcaggccttcctgctgtatctccagctgctgcaaacccagctgctgcaggaccacctgctgccgccccagctgctgcatttctagttgctgcaggccttcctgctgtatctctagctgttgcaaacccagctgctgccagaccacctgctgccgccccagctgctgtatctccagctgctacaggccccagtgctgccagccctcctgctgccgcccggcttgctgcatttctagttgctgtcatcccagctgctgtgtgtccagctgccgctgccctttcagctgcccgaccacctgctgtagaacaacctgcttccaccccatctgctgcggcagttcttgctgctgagtgaagctgctctggatttgtgcaccttcttgctctcaaccttcagttcaggcacagagtatctattcagagaacatgtggacttcctgatgtcgtgaaaacagaggcatggactgatttggaaaatattttattagtatgtattctcttttatagaagtttttattcctattgaatctgaatttacagtcaaattccacatcacatgttttagaattctttattctaattcaatatacataaatcttcaaatggtatccttctagatgtttcttcctaatgttttctgtggtatcaattttcatgtggaattgtttgatgttcctcaataaaacttcatagtgttcaaaagca

SEQ ID NO: 145614 - DNA, 1081 bp, Homo sapiens
  Payload ID: 8857
  Gene Symbol: KRTAP4-4
  Gene Name: keratin associated protein 4-4
  Uniprot ID: Q9BYR3
  ENST ID: ENST00000390661
  CDS Start-End: 41-541
cttcctggaaacccacccagaacctccaccctctgacaccatggtcaactcctgttgtggctctgtgtgctctgaccagggctgtggcctagagaactgctgccgtcccagctactgccagaccacctgctgcaggaccacctgctgccgccccagctgctgtgtgtccagctgctgcagaccccagtgctgccagaccacctgctgcaggaccacctgctgccaccccagctgctgtgtgtccagctgctgcagaccccagtgctgccagtctgtgtgctgccagcccacctgctgcagaccccaatgctgccagactacctgctgtaggaccacctgctgccgccccagctgctgcaggccccagtgctgccagtctgtgtgctgccagcccacctgctgctgccccagctactgtgtgtccagctgctgcagaccccagtgctgccagaccacctgctgcagaaccacctgctgccgccccagctgctgtgtgtccaggtgctacaggccccattgtggccagtctctatgctgctagcccatctgctggcaaaccacctgctacaggaccacctgctgccaccccagctattgcatttccagctgctgccagccttcctgcagtatctctagcagcagtagctcctcctgctgtggcttcagctgctgcaggctctcctgctgcatctccagttgctgccgccccaactgctgccagaccatgtgctgccgcccaacctgctctagtgcttcttgctgctgaggctgtcatctggactcaccagattctcatcaaccagcattcttgatgtagctcatctatgagctgagttatgggaagctagttggaaaacttcagttccaaccaattcttagattgaatctggcctccaaatatatgctccccccacattttacctctctaccaaatgaacataagttgtaatttgctctgaaatctgtcaactatcttaattgaaatatttgctctctgccataatttctcatatggagctattccattttaaacaaatatttatctaaataaatcttaaataaattttcaggcatagaaata

SEQ ID NO: 145615 - DNA, 879 bp, Homo sapiens
  Payload ID: 8858
  Gene Symbol: KRTAP4-5
  Gene Name: keratin associated protein 4-5
  Uniprot ID: Q9BYR2
  ENST ID: ENST00000343246
  CDS Start-End: 36-581
tagaaatccacccagaacctccaccctctgacaccatggtcagctcctgttgtggctctgtcagctctgagcagagctgtggcctggagaactgctgccgccccagctgctgccagaccacctgctgcaggaccacctgctgccgccccagctgctgcaagccccagtgctgccagtctgtgtgctaccagcccacctgctgccaccctagctgctgcatctccagctgctgccgcccctattgctgtgaatccagctgctgccgcccctgctgctgccagaccacctgctgcaggaccacctgctgcaggaccacctgctgctgccccagctgctgtgtgtccagctgctgcagaccccagtgctgccagtctgtgtgctgccagcccacttgctgccgtcccagctgctgcatctccagctgctgccacccctcttgctgtgaatccagctgctgccgcccctgctgctgcgtgcgtccagtctgtggccgagtctcctgccacaccacttgctatcgcccaacctgtgtcatctccacctgcccccgccccttgtgctgtgcctcctcttgctgctaatgtctccttgtgatatttgtcatactatgaatgtcttcattagtcatttaaaatgcactgtagccagccagtcactggaaaaatgaacacttccctgccagtttgtctcatgtggcattcagagtggacattcagctcttctaggaaatgacagacaatcacattcattaaaatatgttatgccaggccccaatgcagttatttttagatgagcagtgtcttcattcgaaggggacactaactgtgatgatctcatataatattgttttcatgtattaataaacagccacttccctaa

SEQ ID NO: 145616 - DNA, 1055 bp, Homo sapiens
  Payload ID: 8859
  Gene Symbol: KRTAP4-6
  Gene Name: keratin associated protein 4-6
  Uniprot ID: Q9BYQ5
  ENST ID: ENST00000345847
  CDS Start-End: 1-618
atggtcagctcctgttgtggttccgtctgctctgaccagggctgtggcctggagacctgctgccgccccagctgctgtcagaccacctgctgcaggaccacctgctgccgccccagctgctgtgtgtccagctgctgcagaccccagtgctgccagtctgtgtgctgccagcccacctgctgccgtcccagctgctgtcccagctgctgtcagaccacctgctgcaggaccacctgctgccgccctagctgctgtgtatccagctgctgcagaccccagtgctgccagtctgtgtgctgccagcccacttgctgccgtcccagctgcagcatctccagctgctgtcgccccagctgctgtgtgtccaggtgctgcaggtcccagtgctgccagtctgtgtgctgccagccaacctgctgccgtcccagctgctgcatctccagctgctgccgcccctcttgctgtgaatccagctgctgccgcccgtgctgctgccgcccctgctgctgcctgcgtccagtctgtggccgagtctcctgccacaccacttgctatcgcccaacctgtgtcatttccacctgcccccgtcccttgtgctgtgcctcctcttgctgctgagctccttgcctgaaactatctcctccccttcagctcactcctcacagaagcagaccttgtgcatctcataaacaactcagaagaggccattcccaccaactgtgtttccatatcctggacatatatctaggatatatgtcctggctatacatctagaatatatgttccccatgttgacccaagtgtgaaattagatattatttacagaaagaaattaatagaatttaccaaattttataccttatatttgtatttatggataccaagttcttctgtcccaaacatggaaattcttgcagggtaactcggggcaaggttgtctcactctcagatttgaaagtctgattgtttcaccctgtatttccttttacagcaatgtttctgtatcttatttttgctgcttctgaataaaactccacttttgtcgcatagaaata

SEQ ID NO: 145617 - DNA, 992 bp, Homo sapiens
  Payload ID: 8860
  Gene Symbol: KRTAP4-7
  Gene Name: keratin associated protein 4-7
  Uniprot ID: Q9BYR0
  ENST ID: ENST00000391417
  CDS Start-End: 58-525
aaacccaagaacttcactctcttggaaacccacccagatcctccccgttctgacaccatggtcagctcctgttgtggctccgtgtgctctgaccagggctgcagccaagacctctgtcaggagacctgctgccgccccagctgctgtcagaccacctgttgcaggaccacctgctaccgccccagctgttgtgtgtccagctgctgcaggccccagtgctgccagtctgtgtgctgccaacccacctgctgtcgccccacctgctgtgagacgacctgctgccaccctaggtgctgcatctccagctgctgccgccccagctgctgtatgtccagctgctgcaagccccagtgctgccagtctgtgtgctgccagcccacctgctgccgccccagctgctgccgcccctgctgctgcctgcgtccagtctgtggccgagtctcctgccacaccacttgctatcgcccaacctgtgtcatctccacctgtccccgccccttgtgctgtgcctcctcttgctgctgagcccactgccctggctcacgtcccccttcaccactggcccacagatgtagacccttctactgtgctgaccattaggatacatgaagtggggttgatgtcattcaataggatggaccttatgcttccaaagagcccaccaccatttcactgactctgtgagaacattctggttcattttaaactccctcctttgctttctttttcttctggtggtggcaccaaatgtgaattaatttgtaatacactagctaagaaattattccaatcttctgatttccttattttctttatcactttaaggtacagattctccttctcagtgaggtagatattatctgcaggaccagttttgtcactgatgttgcaccctcagatccagccacccaattgtattctgtgtttctcctagggtgaatttcttatgctttgttgtatctctgctttctaataaacttttctgcacttaa

SEQ ID NO: 145618 - DNA, 423 bp, Homo sapiens
  Payload ID: 8860
  Gene Symbol: KRTAP4-7
  Gene Name: keratin associated protein 4-7
  ENST ID: ENST00000621138
  CDS Start-End: 1-423
atggtcagctcctgttgtggctccgtgtgctctgaccagggctgcagccaagacctctgtcaggagacctgctgccgccccagctgctgtcagaccacctgttgcaggaccacctgctaccgccccagctgttgtgtgtccagctgctgcaggccccagtgctgccagtctgtgtgctgccaacccacctgctgtcgccccacctgctgtgagacgacctgctgccaccctaggtgctgcatctccagctgctgccgccccagctgctgtatgtccagctgctgcaagccccagtgctgccagtctgtgtgctgccagcccacctgctgccgccccagctgctgccgcccctgctgctgccgcccaacctgtgtcatctccacctgtccccgccccttgtgctgtgcctcctcttgctgctga

SEQ ID NO: 145619 - DNA, 690 bp, Homo sapiens
  Payload ID: 8860
  Gene Symbol: KRTAP4-7
  Gene Name: keratin associated protein 4-7
  ENST ID: ENST00000612231
  CDS Start-End: 27-644
acccagatcctccccgttctgacaccatggtcagctcctgttgtggctccgtgtgctctgaccagggctgcagccaagacctctgtcaggagacctgctgccgccccagctgctgtcagaccacctgttgcaggaccacctgctaccgccccagctgttgtgtgtccagctgctgcaggccccagtgctgccagtctgtgtgctgccaacccacctgctgtcgccccacctgctgtgagacgacctgctgccaccctaggtgctgcatctccagctgctgccgccccagctgctgtatgtccagctgctgcaagccccagtgctgccagtctgtgtgctgccagcccacctgctgccgccccagctgctgcatctccagctgctgtcgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccagctgcccccgccccttgtgctgtgcctcctcttgctgctgagcccactgccctggcttatctcccccttcaccactggcccacagat

SEQ ID NO: 145620 - DNA, 468 bp, Homo sapiens
  Payload ID: 8861
  Gene Symbol: KRTAP4-8
  Gene Name: keratin associated protein 4-8
  ENST ID: ENST00000318329
  CDS Start-End: 1-468
atggtcaactcctgttgtggctccgtgtgctctgaccaaggctgtggccaagacctctgccaggagacctgctgctgccccagctgctgtcagaccacctgctgcaggaccacctgctaccgccccagctacagtgtgtcctgctgctgcagaccccagtgctgccagtctgtgtgctgccagcccacctgctgtcgccccagctgctgtgtgcccacctgctgccaccctagctgctgcatctccagctgctgccgccccagctgctgtgtgtccagctgctgcaagccccagtgctgccagtctgtgtgctgccagcccaactgctgccgccccagctgctgccgcccctgctgctgcctgcgtccagtctgtggccgagtctcctgccacaccacttgctatcgcccagcctgtgtcatctccacctgcccccgccccgtgtgctgcgcctcctcttgctgctga

SEQ ID NO: 145621 - DNA, 1161 bp, Homo sapiens
  Payload ID: 8861
  Gene Symbol: KRTAP4-8
  Gene Name: keratin associated protein 4-8
  Uniprot ID: Q9BYQ9
  ENST ID: ENST00000333822
  CDS Start-End: 58-615
aaactcaagaactttactctcttggaaacccaaatagatccttcaccctctgacaccatggtcaactcctgttgtggctccgtgtgctctgaccaaggctgtggccaagacctctgccaggagacctgctgctgccccagctgctgtcagaccacctgctgcaggaccacctgctaccgccccagctacagtgtgtcctgctgctgcagaccccagtgctgccagtctgtgtgctgccagcccacctgctgtcgccccagctgctgtgtgtccagctgctgcaagccccagtgctgccagtctgtgtgctgccagcccacctgctgccaccctagctgctgcatctccagctgctgccgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcctgcgtccagtctgtggccgagtctcctgccacaccacttgctatcgcccagcctgtgtcatctccacctgcccccgccccgtgtgctgcgcctcctcttgctgctgagcccactgccctggctcatctctcccttcaccgctggtccacaaatgtagaccattcttctgtgctgaatattaggacacatggagtgggatttatgtcattcagcagggtggacctcatgtatccaatgagcccatcaccatcccgctgactctgtgagaacattctggttcattttaaactccctcccttgctttctttttcttccagtcatggcaccaaatacgaattaatttgtaatccactagctaagaaattattccaatcctctaaattcctcattttttaaaatcattttgagcctacagaatatccttcccaattaggtacacattatctccctttcaaacatactatttgtctgtcagcctttcagtcattcttttcttttggaaaggtaggaggctgcccctcccgtgctctcccgctttctccctgctctctctttctctcactgttcaagtttgtcagaatttttctattttattagttctttatctttattgtgttcacaaaatatattgtattaaacttttcatttagaaa

SEQ ID NO: 145622 - DNA, 588 bp, Homo sapiens
  Payload ID: 8861
  Gene Symbol: KRTAP4-8
  Gene Name: keratin associated protein 4-8
  ENST ID: ENST00000574631
  CDS Start-End: 1-588
atggtcaactcctgttgtggctccgtgtgctctgaccaaggctgtggccaagacctctgccaggagacctgctgctgccccagctgctgtcagaccacctgctgcaggaccacctgctaccgccccagctacagtgtgtcctgctgctgcagaccccagtgctgccagtctgtgtgctgccagcccacctgctgccgccccagatgctgcatctccagctgctgtcgccccagctgctgtgtgtccagctgctgcaagccccagtgctgccagtctgtgtgctgccagcccacctgctgccaccctagctgctgcatctccagctgctgccgccccagctgctgtgtgtccagctgctgcaagccccagtgctgccagtctgtgtgctgccagcccacctgctgccaccctagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccacctgtccccgccccgtgtgctgcgcctcctcttgctgctga

SEQ ID NO: 145623 - DNA, 1144 bp, Homo sapiens
  Payload ID: 8861
  Gene Symbol: KRTAP4-8
  Gene Name: keratin associated protein 4-8
  ENST ID: ENST00000612944
  CDS Start-End: 41-598
ctcttggaaacccaaatagatccttcaccctctgacaccaatggtcaactcctgttgtggctccgtgtgctctgaccaaggctgtggccaagacctctgccaggagacctgctgctgccccagctgctgtcagaccacctgctgcaggaccacctgctaccgccccagctacagtgtgtcctgctgctgcagaccccagtgctgccagtctgtgtgctgccagcccacctgctgtcgccccagctgctgtgtgtccagctgctgcaagccccagtgctgccagtctgtgtgctgccagcccacctgctgccaccctagctgctgcatctccagctgctgccgccccagctgctgtgtgtccagctgctgcaagccccagtgctgccagtctgtgtgctgccagcccacctgctgccaccctagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccacctgtccccgccccgtgtgctgcgcctcctcttgctgctgagcccactgccctggctcatctctcccttcgccgctggtccacaaatgtagaccattcttctgtgctgaatattaggacacatggagtgggattgatgtcattcagcagggtggacctcatgtatccaatgagcccatcaccatcccgctgactctgtgagaacattctggttcattttaaactccctcccttgctttatttttcttccagtcatggcaccaaatacgaattaatttgtaatccactagctaagaaataattccaatcctctaaattcctcattttttaaaatcattttgagcctacagaatatccttcccaattaggtacacattatctccctttcaaacatactatttgtctgtcagcctttcagtcattcttttcttttggaaaggtaggaggctgcccctcccgtgctctcccgctttctccctgctccctctttctctcactgttcaagtttgccagaatttttctattttattagttctttatctttattgtgttcacaaaatatattgtattaaacttttcatttagaaa

SEQ ID NO: 145624 - DNA, 1157 bp, Homo sapiens
  Payload ID: 8862
  Gene Symbol: KRTAP4-9
  Gene Name: keratin associated protein 4-9
  Uniprot ID: Q9BYQ8
  ENST ID: ENST00000391415
  CDS Start-End: 58-690
aaacccaagaacttcactctcttggaagcccacccagatcctccccgttctgacaccatggtcagctcctgttgtggctccgtgtgctctgaccagggctgcggccaagacctctgtcaggagacctgctgccgccccagctgctgtgagaccacctgctgcaggaccacctgctgccgccccagctgttgtgtatccagctgctgcaggccccagtgctgccagtctgtgtgctgccaacccacttgttcccgccccagctgctgtcagaccacctgttgcaggaccacctgctaccgccccagctgttgtgtgtccagctgctgcaggccccagtgctgccagcctgcgtgctgccaacccacttgctgtcgccccagctgctgtgagacgacctgctgccaccctaggtgctgcatctccagctgctgtcgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccagctgcccccgccccttgtgctgtgcctcctcttgctgctgagcccactgccctggcttatctcccccttcaccactggcccacagatgtagacccttctactgtgctgaccattaggatacaggaagtggggttgatgtcattcaatagaatggaactcatgtttccaatgagcccatcaccatttcactgactctttgagaacattctgattcattttaaactccctcccttgctttctttttcttccggtggtggcaccaaatgtgaattaatttgtaatccactagctagaaattattccaatcctctaatttcctcattttctttatcactttgaggtacagatcttcttctcagtgaggcagacattatctgcaggaccagttttgtcactgaggttgcaccctcagatccagccgcccagttatattctgtgtttctcctagtgtgaatttcttatgctttgttgcatctctgctttttaataaaatttctgtacataagaa

SEQ ID NO: 145625 - DNA, 1157 bp, Homo sapiens
  Payload ID: 8862
  Gene Symbol: KRTAP4-9
  Gene Name: keratin associated protein 4-9
  ENST ID: ENST00000574465
  CDS Start-End: 58-690
aaacccaagaacttcactctcttgaaaacccacccagatcctccccgttctgacaccatggtcagctcctgttgtggctccgtgtgctctgaccagggctgcggccaagacctctgtcaggagacctgctgccgccccagctgctgtgagaccacctgctgcaggaccacctgctgccgccccagctgttgtgtatccagctgctgcaggccccagtgctgccagtctgtgtgctgccaacccacttgttcccgccccagctgctgtcagaccacctgttgcaggaccacctgctaccgccccagctgttgtgtgtccagctgctgcaggccccagtgctgccagcctgtgtgctgccaacccacctgctgtcgccccagctgctgtgagacgacctgctgccaccctaggtgctgcatctccagctgctgtcgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccagctgcccccgccccttgtgctgtgcctcctcttgctgctgagcccactgccctggcttatctcccccttcaccactggcccacagatgtagacccttctactgtgctgaccattaggatacaggaagtggggttgatgtcattcaatagaatggaactcatgtttccaatgagcccatcaccatttcactgactctttgagaacattctgattcattttaaactccctcccttgctttctttttcttccggtggtggcaccaaatgtgaattaatttgtaatccactagctagaaattattccaatcctctaatttcctcattttctttatcactttgaggtacagatcttcttctcagtgaggcagacattatctgcaggaccagttttgtcactgaggttgcaccctcagatccagccgcccagttatattctgtgtttctcctagtgtgaatttcttatgctttgttgcatctctgctttttaataaaatttctgtacataagaa

SEQ ID NO: 145626 - DNA, 558 bp, Homo sapiens
  Payload ID: 8862
  Gene Symbol: KRTAP4-9
  Gene Name: keratin associated protein 4-9
  ENST ID: ENST00000617453
  CDS Start-End: 1-558
atggtcagctcctgttgtggctccgtgtgctctgaccagggctgcggccaagacctctgtcaggagacctgctgccgccccagctgctgtgagaccacctgctgcaggaccacctgctgccgccccagctgttgtgtatccagctgctgcaggccccagtgctgccagtctgtgtgctgccaacccacttgttaccgccccagctgttgtgtgtccagctgctgcaggccccagtgctgccagcctgcgtgctgccaacccacttgctgtcgccccaggtgctgcatctccagctgctgtcgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccagctgcccccgccccttgtgctgtgcctcctcttgctgctga

SEQ ID NO: 145627 - DNA, 942 bp, Homo sapiens
  Payload ID: 8863
  Gene Symbol: KRTAP5-1
  Gene Name: keratin associated protein 5-1
  Uniprot ID: Q6L8H4
  ENST ID: ENST00000382171
  CDS Start-End: 35-871
cctctacctgctccaccctcaatccaccagaaccatgggctgttgcggctgctccggaggctgtggctccagctgtgggggctgtggctccggctgtgggggctgtggctccggctgtgggggctgtggctctggctgtggaggttctggctccagctgctgtgtgcccgtctgctgctgcaagcccgtgtgctgccgtgtgccaacctgttcctgctccagctgtggcaaagggggctgtggctcttctgggggctccaaggggggctgtggctcctgtggaggctgcaaggggggctgtggctcttgtgggggatccaaggggggttgtggctcctgtgggggctccaaggggggctgtggctcttgtgggggatccaagggtggctgtggttccggctgtgggggatgtggctccagctgctgtgtgcctgtctgctgctgcaagcccatgtgctgctgtgtgccagcttgttcctgctccagctgtggcaaagggggctgtggctcctgtgggtgctccaagggggcctgtggttcttgtgggggctccaaggggggctgtggctcctgtggaggctgcaaggggggctgcggttcttgtgggggatccaaggggggttgtggctccggctgtgggggctgtggctccggctgcggtgtgcccgtgtgttgctgttcctgttccagttgtggctcttgcgcggggtctaagggaggctgcgggtcatcctgctcccagtgcagttgctgtaagccctgctgctgttcctcaggctgtgggtcatcctgttgccaatccagctgctgcaagccctgctgctcccagtccagttgctgtgtccccgtgtgctgccagtgcaagatctgatttctggctttgcaggactcttaccatggccaggcattcctgcccagcctttacctccttttcctggcacc

SEQ ID NO: 145628 - DNA, 942 bp, Homo sapiens; identical to SEQ ID NO: 145627
  Payload ID: 8863
  Gene Symbol: KRTAP5-1
  Gene Name: keratin associated protein 5-1
  Uniprot ID: Q6L8H4
  ENST ID: ENST00000619083
  CDS Start-End: 35-871

SEQ ID NO: 145629 - DNA, 942 bp, Homo sapiens; identical to SEQ ID NO: 145627
  Payload ID: 8863
  Gene Symbol: KRTAP5-1
  Gene Name: keratin associated protein 5-1
  Uniprot ID: Q6L8H4
  ENST ID: ENST00000625554
  CDS Start-End: 35-871

SEQ ID NO: 145630 - DNA, 504 bp, Homo sapiens
  Payload ID: 8864
  Gene Symbol: KRTAP5-10
  Gene Name: keratin associated protein 5-10
  ENST ID: ENST00000376536
  CDS Start-End: 1-504
atgggctgctgtggctgctccggaggctgtggctccggctgtgggggttgtggctccggctgtgggggctgtggctccggctgtgggggctatggctctggctgtgggggctgtggctccagctgctgtgtgcccgtctgctgctgcaagcccgtgtgctgctgtgtgccagcctgttcctgctccagctgtggctcctgtgggggctccaagggtggctgtggttcctgtgggggctccaaggggggctgtggttcttgtggctgctcccagtgcaattgctgtaagccctgctgctgctcctcaggctgtggatcctgctgccagtccagctgctgcaatccctgctgctgccagtccagctgctgtgtccccgtgtgctgccagtctagctgctgcaagccctgctgctgtcagtccagctgctgtgtctccagctgctgcaggtcctgctgctccaagtccagctgctgtgtccctatttgctgtcagtacaagatctga

SEQ ID NO: 145631 - DNA, 1176 bp, Homo sapiens
  Payload ID: 8864
  Gene Symbol: KRTAP5-10
  Gene Name: keratin associated protein 5-10
  Uniprot ID: Q6L8G5
  ENST ID: ENST00000398531
  CDS Start-End: 26-634
gatccaccctcaatctaccagaatcatgggctgctgtggctgctccggaggctgtggctccggctgtgggggttgtggctccggctgtgggggctgtggctccggctgtgggggctatggctctggctgtgggggctgtggctccagctgctgtgtgcccgtctgctgctgcaagcccgtgtgctgctgtgtgccagcctgttcctgctccagctgtggctcctgtgggggctccaagggggactgtggctcttgtgggggctccaaagggggctgtggttcctgtgggggctccaaggggggctgtggctcctgtgggggctccaaggggggctgtggttcttgtgggggctccaaggggggctgtggctcctgtgggggctccaaaggtggctgtggttcctgtgggggctccaaggggggctgtggttcttgtggctgctcccagtgcaattgctgtaagccctgctgctgctcctcaggctgtggatcctgctgccagtccagctgctgcaatccctgctgctgccagtccagctgctgtgtccccgtgtgctgccagtctagctgctgcaagccctgctgctgtcagtccagctgctgtgtccccgtgtgctgccagtgtaagatctgaggctctgaacccagaccttcaggtttcacctgtttggtgaaagcatttgttatgatttccctgaattaattcatcccacgcatcctccctgaggcacctgccccttctccagctcatcatccatgcacgcacctccttccatggctcagctctccactgggccctgccttcagcctcctcactccggaaatgcatgtttccttgatgcaggaggtggccttgcctggacgcgggcacccagccaactgccatggtgttccctgcacttgggtgtggaccatcttcttcttctccctcggctgactgagatgcaaggtctgaccccacaaggccaggccaatgttgctcagtgatcactaagaaccagcttctcaaccaccattgggaccctggatcctccagggccgctcgctgcctgttctccagtggccacctgtgaccaggaaggtctccttccttcctgttgtctccatctatttaaaaacaataacaaagtaatgaatgaatttccttacaataaagcctctcatgtctgtaaatca

SEQ ID NO: 145632 - DNA, 1021 bp, Homo sapiens
  Payload ID: 8865
  Gene Symbol: KRTAP5-11
  Gene Name: keratin associated protein 5-11
  Uniprot ID: Q6L8G4
  ENST ID: ENST00000398530
  CDS Start-End: 39-509
tgctcctctacctgctctactctcaatccgccagaatcatgggctgctgtggctgttctggaggctgtggctctggctgtgggggctgtggctccggcagtgggggctgtggctctggctgtgggggctgtggctccagctgctgtgtgcccatttgctgctgcaagcctgtgtgctgctgtgtgccagcctgttcctgctccagctgtggctcctgtgggggctccaaagggggctgtggctcttgtgggagctccaagggtgggtgtggttcttgtggctgctcccagtccaactgctgtaagccctgctgctcctcctcaggctgtgggtcattctgctgccagtccagctgctccaaaccctgctgctgccaatccagctgctgccagtccagctgctgcaagccctgctgctgccaatccagctgctgccagtctagctgcttcaagccctgctgctgccagtccagctgctgtgtccccgtgtgctgccagtgtaagatctgaggctctggacccagaccttcaggtttctcctctttggtgaaagcatttcttatggtttctctgaatcagttcatcccacacatcatcctgaggcacctgcacctgctctagctcatcatccatgcatgcacctctttccatggctcggctctcctctaggccctgccttcagcttcctcactccggaaacatgtgtttccttgatgcaggaggtgttcttccctggacgccatggtgttccctgcacttgggtgtggaccatcttcttcttctccctgggctgactgagatgctaggtctgaccccacaaggccaggccgacattcctgagtgatcactaagaaccagtttctcaaccaccactgggattctgggtcctcctgggctgctgcctgttctcctgtgacccacctgtgagcaagaaggtctccttccttcctgttgtctccatctatttaaaaaaaaaatgaatgaatttccttgcaataaagcctctcatgtctgtaaaccaa

SEQ ID NO: 145633 - DNA, 531 bp, Homo sapiens
  Payload ID: 8865
  Gene Symbol: KRTAP5-11
  Gene Name: keratin associated protein 5-11
  ENST ID: ENST00000616086
  CDS Start-End: 1-531
atgggctgctgtggctgttctggaggctgtggctctggctgtgggggctgtggctccggcagtgggggctgtggctctggctgtgggggctgtggctccagctgctgtgtgcccatttgctgctgcaagcctgtgtgctgctgtgtgccagcctgttcctgctccagctgtggctcctgtgggggctccaaagggggctgtggctcttgtgggagctccaagggtgggtgtggttcttgtggctgctcccagtccaactgctgtaagccctgctgctcctcctcaggctgtgggtcattctgctgccagtccagctgctccaaaccctgctgctgccaatccagctgctgccagtccagctgctgcaagccctgctgctgccaatccagctgctgccagtctagctgcttcaagccctgctgctgccagtccagctgctgtgtccccgtgtgctgccactccagctgctgcaagccctgctgctcccagtccagctgctgtgtccctatttgctgtcagtacaagatctga

SEQ ID NO: 145634 - DNA, 558 bp, Homo sapiens
  Payload ID: 8865
  Gene Symbol: KRTAP5-11
  Gene Name: keratin associated protein 5-11
  ENST ID: ENST00000617152
  CDS Start-End: 1-558
atgggctgctgtggctgttctggaggctgtggctctggctgtgggggctgtggctccggcagtgggggctgtggctctggctgtgggggctgtggctccagctgctgtgtgcccatttgctgctgcaagcctgtgtgctgctgtgtgccagcctgttcctgctccagctgtggctcctgtgggggctccaaagggggctgtggctcttgtgggagctccaagggtgggtgtggttcttgtggctgctcccagtccaactgctgtaagccctgctgctcctcctcaggctgtgggtcattctgctgccagtccagctgctccaaaccctgctgctgccaatccagctgctgccagtccagctgctgcaagccctgctgctgccaatccagctgctgccagtctagctgcttcaagccctgctgctgccagtccagctgctgcaaactctgctgctgctcctcaggctgtggatcaacctgctcccagtccagctgctgcaagccctgctgctcccagtccagctgctgtgtccctatttgctgtcagtacaagatctga

SEQ ID NO: 145635 - DNA, 1118 bp, Homo sapiens
  Payload ID: 8866
  Gene Symbol: KRTAP5-2
  Gene Name: keratin associated protein 5-2
  Uniprot ID: Q701N4
  ENST ID: ENST00000412090
  CDS Start-End: 45-578
ctcacctgctcctctacctgctccaccctcaatccaccagaaccatgggctgctgtggctgctccagaggctgtggctccggctgtgggggctgtggctccagctgtgggggttgtggctctggctgtgggggctgtggctccggccgtgggggctgtggctctggctgtgggggctgcagctccagctgtgggggatgtggctccagatgttatgtgcctgtctgctgctgcaagcccgtgtgctcctgggtgccagcctgttcctgcaccagctgtggctcctgtgggggctccaaggggggctgtggctcctgtgggggctccaaggggggctgtggctcctgtgggggttccaaggggggctgtggttcttgtggctgctcccagtccagctgttgtaagccctgttgctgctcctcaggctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctgaggctctggacccagaccttcaggtttctcctgtttggtgaaagcatttcttatggttccctgagtcagttcgtcccacacatcctccctgaggcacctgcacctgctctagctcaccatccatgcacacacctccttccatggctcagctctcctctgggccctgccttcagcctcctcactccagaaacgtgtgtttccctgatgcgggaggtgtcctcgcctggacgcaggcacccagccgactgccacgatgttccctgcacttgggtgtggaccatcttcttcttctccctgggctgactgagatgcaaggtctgaccccacaaggccaggccgacgtttctgagtgatcactaagaaccagcttctcaaccaccatcaggaccctggatcctcctgggccgctgcctgttctcctgtggcccaagtgtgaccaggaaggtctctttccttcctgttgtctccatctgtttaaaaaaaaataacaaaataatgaatgaatttccttgcaataaagcctctcatgtctgtaaatcaa

SEQ ID NO: 145636 - DNA, 1118 bp, Homo sapiens; identical to SEQ ID NO: 145635
  Payload ID: 8866
  Gene Symbol: KRTAP5-2
  Gene Name: keratin associated protein 5-2
  Uniprot ID: Q701N4
  ENST ID: ENST00000612541
  CDS Start-End: 45-578

SEQ ID NO: 145637 - DNA, 1118 bp, Homo sapiens; identical to SEQ ID NO: 145635
  Payload ID: 8866
  Gene Symbol: KRTAP5-2
  Gene Name: keratin associated protein 5-2
  Uniprot ID: Q701N4
  ENST ID: ENST00000628787
  CDS Start-End: 45-578

SEQ ID NO: 145638 - DNA, 899 bp, Homo sapiens
  Payload ID: 8867
  Gene Symbol: KRTAP5-3
  Gene Name: keratin associated protein 5-3
  Uniprot ID: Q6L8H2
  ENST ID: ENST00000399685
  CDS Start-End: 79-795
gggctcagagaactccacacctgcacacctccctctcacctgctcctctacctgctccaccctcaacccaccagaaccatgggctgctctggctgctctggaggctgtggctccagctgtgggggctgtggctccagctgtgggggctgtggctccggctatgggggctgtggctccggctgctgtgtacctgtctgctgctgcaagcccgtgtgctgctgtgtgccagcctgttcctgctccagctgtggctcctgtgggggctccaagggggtctgtggctcttgtgggggctgcaaggggggctgtggctcctgtggaggctccaaggggggctgtggctccagctgctgtgtgcccgtctgctgctcctccagctgtggctcctgtgggggttccaagggggtctgtggatttcgtgggggctccaaggggggctgcggttcttgtggctgctcccagtgcagctgctataagccctgctgctgctcctcaggctgtgggtcatcctgctgccagtccagctgctgcaagcccagctgctcccagtccagctgctgtaagccctgctgttcccagtccagctgctgtaagccctgctgctgctcctcaggctgtgggtcatcctgctgccagtccagctgctgcaaaccctgctgttcccagtccagctgctgtaagccctgctgctgctcctcaggctgtgggtcatcctgctgccagtccagctgctgcaagccctgctcctcccagtccagctgctgtgtcccaatttgctgccagtgcaagatctgaggctctgcccacaaacctcagtgggtcctacagatccgggctctccaggaatgattgcagctgtgtcctgaattcctgaagcacgtctctgaatctgtcctcct

SEQ ID NO: 145639 - DNA, 899 bp, Homo sapiens; identical to SEQ ID NO: 145638
  Payload ID: 8867
  Gene Symbol: KRTAP5-3
  Gene Name: keratin associated protein 5-3
  Uniprot ID: Q6L8H2
  ENST ID: ENST00000620564
  CDS Start-End: 79-795

SEQ ID NO: 145640 - DNA, 510 bp, Homo sapiens
  Payload ID: 8867
  Gene Symbol: KRTAP5-3
  Gene Name: keratin associated protein 5-3
  ENST ID: ENST00000616336
  CDS Start-End: 1-510
atgggctgctctggctgctctggaggctgtggctccagctgtgggggctgtggctccagctgtgggggctgtggctccggctatgggggctgtggctccggctgctgtgtacctgtctgctgctgcaagcccgtgtgctgctgtgtgccagcctgttcctgctccagctgtggcaaggggggctgtggctcctgtgggggctccaaggggggctgcggttcttgtggctgctcccagtgcagctgctgtaagccctgctgctgctcctcaggctgtgggtcatcctgctgccagtccagctgctgcaaaccctgctgttcccagtccagctgctgtaagccctgctgctgctcctcaggctgtgggtcatcctgctgccagtccagctgctgcaagccctgctgctgttcctcaggctgtgggtcatcctgttgccaatccagctgctgcaagccctgctgctcccagtccagttgctgtgtccccgtgtgctgccagtgcaagatctga

SEQ ID NO: 145641 - DNA, 899 bp, Homo sapiens
  Payload ID: 8867
  Gene Symbol: KRTAP5-3
  Gene Name: keratin associated protein 5-3
  Uniprot ID: Q6L8H2
  ENST ID: ENST00000627584
  CDS Start-End: 79-795
gggctcagagaactccaaacctgcacacctccctctcacctgctcctctacctgctccaccctcaacccaccagaaccatgggctgctctggctgctctggaggctgtggctccagctgtgggggctgtggctccagctgtgggggctgtggctccggctatgggggctgtggctccggctgctgtgtacctgtctgctgctgcaagcccgtgtgctgctgtgtgccagcctgttcctgctccagctgtggctcctgtgggggctccaagggggtctgtggctcttgtgggggctgcaaggggggctgtggctcctgtggaggctccaaggggggctgtggctccagctgctgtgtgcccgtctgctgctcctccagctgtggctcctgtgggggttccaagggggtctgtggatttcgtgggggctccaaggggggctgcggttcttgtggctgctcccagtgcagctgctataagccctgctgctgctcctcaggctgtgggtcatcctgctgccagtccagctgctgcaagcccagctgctcccagtccagctgctgtaagccctgctgttcccagtccagctgctgtaagccctgctgctgctcctcaggctgtgggtcatcctgctgccagtccagctgctgcaaaccctgctgttcccagtccagctgctgtaagccctgctgctgctcctcaggctgtgggtcatcctgctgccagtccagctgctgcaagccctgctcctcccagtccagctgctgtgtcccaatttgctgccagtgcaagatctgaggctctgcccacaaacctcagtgggtcctacagatccgggctctccaggaatgactgcagctgtgtcctgaattcctgaagcacgtctctgaatctgtcctcct

SEQ ID NO: 145642 - DNA, 1181 bp, Homo sapiens
  Payload ID: 8868
  Gene Symbol: KRTAP5-4
  Gene Name: keratin associated protein 5-4
  ENST ID: ENST00000399682
  CDS Start-End: 46-732
tctcatctgctcctctacctgctccaccctcaatccaccagaaccatgggctgctgtggctgctctggaggctgtggctccggctgtgggggctgtggctccggctgtgggggctgtggctctggctgtgggggctgtggctccggctgtgggggctgtggctccggctgtgggggctgtggctccagctgctgtgtgcccatctgctgctgcaaacctgtgtgctgctgtgtgccagcctgttcctgctccagctgtggctcctgtgggggctccaaggggggctatggctcttgtgggggttccaaggggggctgtgtctcctgtgggggttccaaggggggctgtggctcctgtgggggctccaaggggggctgtggctcctgtgggggttccaaggggggctgtggctcctgtgggggctccaaaggaggctgtggctcttgtggctgctcccagtgcagctgctgtaagccctgctgcttctcttcaggctgtgggtcatcctgctgccagtccagctgctgtaagccctgctgctcctcctcaggttgtgggtcatcctgctgccagtccagctgctgcaagccctactgctgccagtccagctgctgtaagccctgctgctcctcctcaggttgtgggtcatcctgctgccagtccagttgctgcaatccctgctgctcccagtctagttgctgtgtccctgtgtgctgccagtgtaagatctgaggctctggactcaggcctcatgtgagtcctgctaatcctgtcttccaaagctgtgacctgtccttcattgttgagccccaaatcattgctcagggtccattccctgctgtagaacgatgccatatctggctgccttttcctaagaagagtccaccctaattaatgtccattgtctctcctaacaaattctctccccaagtcaactgcaattgcagctgaatcacccctcacccactagcctcgcctttgctcatcttttcagaggcctgagctcctgaacccacttgcagtcctgtcttttccagctggagcagctgggcataagcgtcccacctgcaacaaggtgggcgtttaagaggcttccttggagtggctttgcatgtccaacactctgctgtatctttttttttttttttttttttttgagatggagtctcgcactgtcaccc

SEQ ID NO: 145643 - DNA, 660 bp, Homo sapiens
  Payload ID: 8868
  Gene Symbol: KRTAP5-4
  Gene Name: keratin associated protein 5-4
  ENST ID: ENST00000617720
  CDS Start-End: 1-660
atgggctgctgtggctgctctggaggctgtggctccggctgtgggggctgtggctccggctgtgggggctgtggctctggctgtgggggctgtggctccggctgtgggggctgtggctccggctgtgggggctgtggctccagctgctgtgtgcccatctgctgctgcaaacctgtgtgctgctgtgtgccagcctgttcctgctccagctgtggctcctgtgggggctccaaggggggctatggctcttgtgggggttccaaggggggctgtgtctcctgtgggggttccaaggggggctgtggctcctgtgggggctccaaggggggctgtggctcctgtgggggttccaaggggggctgtggctcctgtgggggctccaaaggaggctgtggctcttgtggctgctcccagtgcagctgctgtaagccctgctgcttctcttcaggctgtgggtcatcctgctgccagtccagctgctgtaagccctcctgctgccagtccagctgctgcaagccctactgctgccagtccagctgctgtaagccctgctgctcctcctcaggttgtgggtcatcctgctgccagtccagttgctgcaatccctgctgctcccagtctagttgctgtgtccctgtgtgctgccagtgtaagatctga

SEQ ID NO: 145644 - DNA, 660 bp, Homo sapiens; identical to SEQ ID NO: 145643
  Payload ID: 8868
  Gene Symbol: KRTAP5-4
  Gene Name: keratin associated protein 5-4
  ENST ID: ENST00000616115
  CDS Start-End: 1-660

SEQ ID NO: 145645 - DNA, 564 bp, Homo sapiens
  Payload ID: 8868
  Gene Symbol: KRTAP5-4
  Gene Name: keratin associated protein 5-4
  ENST ID: ENST00000615268
  CDS Start-End: 1-564
atgggctgctgtggctgctctggaggctgtggctccggctgtgggggctgtggctccggctgtgggggctgtggctctggctgctgtgtgcccatctgctgctgcaaacctgtgtgctgctgtgtgccagcctgttcctgctccagctgtggctcctgtgggggctccaaggggggctgtggctcctgtgggggttccaaggggggctgtggctcctgtgggggctccaaaggaggctgtggctcttgtggctgctcccagtgcagctgctgtaagccctgctgctgctcttcaggctgtgggtcatcctgctgccagtccagctgctgtaagccctgctgttcccagtccagctgctgtaagccctgctgctgctcctcaggctgtgggtcatcctgctgccagtccagctgctgcaaaccctgctgttcccagtccagctgctgtaagccctgctgctgctcctcaggctgtgggtcatcctgctgccagtccagctgctgcaagccctgctcctcccagtccagctgctgtgtcccaatttgctgccagtgcaagatctga

SEQ ID NO: 145646 - DNA, 900 bp, Homo sapiens
  Payload ID: 8868
  Gene Symbol: KRTAP5-4
  Gene Name: keratin associated protein 5-4
  ENST ID: ENST00000611225
  CDS Start-End: 35-532
cctctacctgctccaccctcaatccaccagaaccatgggctgctgtggctgctctggaggctgtggctccggctgtgggggctgtggctccggctgtgggggctgtggctctggctgtgggggctgtggctccagctgctgtgtgcccatctgctgctgcaaacctgtgtgctgctgtgtgccagcctgttcctgctccagctgtggctcctgtgggggctccaaggggggctgtggctcctgtgggggctccaaggggggctgtggctcctgtgggggttccaaggggggctgtggctcttgtggctgctcccagtgcagctgctgtaagccctgctgctgctcttcaggctgtgggtcatcctgctgccagtccagctgctgtaagccctgctgctgccagtccagctgctgtaagccctgctgctcctcctcaggttgtgggtcatcctgctgccagtccagttgctgcaatccctgctgctcccagtctagttgctgtgtccctgtgtgctgccagtgtaagatctgaggctctggactcaggcctcatgtgagtcctgctaatcctgtcttccaaagctgtgacctgtccttcattgttgagccccaaatcattgctcagggtccattccctgctgtagaacgatgccatatctggctgccttttcctaagaagagtccaccctaattaatgtccattgtctctcctaacaaattctctccccaagtcaactgcaattgcagctgaatcacccctcacccactagcctcgcctttgctcatcttttcagaggcctgagctcctgaacccacttgcagtcctgtcttttccagctggagcagctgggcataagcgtcccacctgctacaaggtgggcgtttaagaggcttccttgg

SEQ ID NO: 145647 - DNA, 1359 bp, Homo sapiens
  Payload ID: 8868
  Gene Symbol: KRTAP5-4
  Gene Name: keratin associated protein 5-4
  Uniprot ID: Q6L8H1
  ENST ID: ENST00000630519
  CDS Start-End: 46-912
tctcatctgctcctctacctgctccaccctcaatccaccagaaccatgggctgctgtggctgctctggaggctgtggctccggctgtgggggctgtggctccggctgtgggggctgtggctctggctgtgggggctgtggttccggctgtgggggctgtggctccggctgtgggggctgtggctccagctgctgtgtgcccatctgctgctgcaaacctgtgtgctgctgtgtgccagcctgttcctgctccagctgtggctcctgtgggggctccaaggggggctatggctcttgtgggggttccaaggggggctgtgtctcctgtgggggttccaaggggggctgtggctcctgtgggggctccaaggggggctgtggctcctgtgggggttccaaggggggctgtggctcctgtgggggctccaaggggggctgtgtctcctgtgggggttccaaggggggctgtggctcctgtgggggttccaaggggggctgtgtctcctgtggggggtccaaggggggctgtggctcctgtgggggctccaaggggggctgtggctcctgtgggggttccaaggggggctgtggctcctgtgggggctccaaaggaggctgtggctcttgtggctgctcccagtgcagctgctgtaagccctgctgctgctcttcaggctgtgggtcatcctgctgccagtccagctgctgtaagccctgctgctcctcctcaggttgtgggtcatcctgctgccagtccagctgctgcaagccctactgctgccagtccagctgctgtaagccctgctgctcctcctcaggttgtgggtcatcctgctgccagtccagttgctgcaatccctgctgctcccagtctagttgctgtgtccctgtgtgctgccagtgtaagatctgaggctctggactcaggcctcatgtgagtcctgctaatcctgtcttccaaagctgtgacctgtccttcattgttgagccccaaatcattgctcagggtccattccctgctgtagaacgatgccatatctggctgccttttcctaagaagagtccaccctaattaatgtccattgtctctcctaacaaattctctccccaagtcaactgcaattgcagctgaatcacccctcacccactagcctcgcctttgctcatcttttcagaggcctgagctcctgaacccacttgcagtcctgtcttttccagctggagcagctgggcataagcgtcccacctgctacaaggtgggcgtttaagaggcttccttggagtggctttgcatgtccaacactctgctgtatctttttttttttttttttttttgagatggagtctcgcactgtcaccc

SEQ ID NO: 145648 - DNA, 1181 bp, Homo sapiens; identical to SEQ ID NO: 145642
  Payload ID: 8868
  Gene Symbol: KRTAP5-4
  Gene Name: keratin associated protein 5-4
  ENST ID: ENST00000629556
  CDS Start-End: 46-732

SEQ ID NO: 145649 - DNA, 933 bp, Homo sapiens
  Payload ID: 8869
  Gene Symbol: KRTAP5-5
  Gene Name: keratin associated protein 5-5
  Uniprot ID: Q701N2
  ENST ID: ENST00000399676
  CDS Start-End: 67-780
ggctccacacctgcacctccctctcacctgctcctctacctgctccaccctcaatccaccagaaccatgggctgctgtggctgctccggaggctgtggctccggctgtggaggccgtggctccggctgtgggggctgtggctccggctgtggaggctgtggctctggctgtgggggctgtggctccggctgtggaggctgtgggggctgtggctccggctgtgcgggctgtgggggatgtggctccggctgctgtgtgcctgtctgctgctgcaagcccatgtgctgctgtgtgccagcttgttcctgctccagctgtggcaaagggggctgtggctcttgcgggggctccaagagaggctgtgtctcctgtggggtgtccaagggggcctgtggctcctgtggggggtccaaggggggctgtggctcctgtggggggtccaaggggggctgtggctcctgtggggggtccaaggggggctgtggctcctgtggggggtccaaggggggctgtggttcttatggctgctcccagtccagctgctgcaagccctgctgctgctcctcaggctgtgggtcatcctgctgccagtccagctgctgtaagccttactgctgccagtccagctgctgtaagccctactgctgccagtccagctgctgtaagccctgtagctgcttctcaggctgtggatcatcctgctgccaatccagctgctacaagccctgctgctgccagtccagctgctgtgtccccgtgtgctgccagtgtaagatctgaggctctgactgcagactgcaggtggcctgactggtgaagggcccggctgcccagcttccttgccctgggttctctggtgctccactgtctccactgtgtcctcactggcttcatccactccacaccagtgctcccgaaactgactgaggaccc

SEQ ID NO: 145650 - DNA, 558 bp, Homo sapiens
  Payload ID: 8869
  Gene Symbol: KRTAP5-5
  Gene Name: keratin associated protein 5-5
  ENST ID: ENST00000613035
  CDS Start-End: 1-558
gggggctgtggctccggctgtggaggccgtggctccggctgtgggggctgtggctccggctgtggaggctgtggctccggctgtgggggctgtggctccggctgtgggggctgtgggggatgtggctccggctgctcttgttcctgctccagctgtggcaaagggggctgtggctcttgcgggggctccaagagaggctgtgtctcctgtggggtgtccaagggggcctgtggctcctgtggggggtccaaggggggctgtggctcctgtggggggtccaaggggggctgtggctcctgtggggggtccaaggggggctgtggttcttatggctgctcccagtgcagctgctgtaagccctgctgctgctcctcaggctgtgggtcatcctgctgccagtccagctgctgtaagccttactgctgccagtccagctgctgtaagccctgtagctgcttctcaggctgtggatcatcctgctgccaatccagctgctacaagccctgctgctgccagtccagctgctgtgtccccgtgtgctgccagtgtaagatctga

SEQ ID NO: 145651 - DNA, 933 bp, Homo sapiens; identical to SEQ ID NO: 145649
  Payload ID: 8869
  Gene Symbol: KRTAP5-5
  Gene Name: keratin associated protein 5-5
  Uniprot ID: Q701N2
  ENST ID: ENST00000618541
  CDS Start-End: 67-780

SEQ ID NO: 145652 - DNA, 885 bp, Homo sapiens
  Payload ID: 8869
  Gene Symbol: KRTAP5-5
  Gene Name: keratin associated protein 5-5
  ENST ID: ENST00000626614
  CDS Start-End: 67-732
ggctccacacctgcacctccctctcacctgctcctctacctgctccaccctcaatccaccagaaccatgggctgctgtggctgctccggaggctgtggctccggctgtggaggccttggctccggctgtgggggctgtggctccggctgtggaggccgtggctccggctgtgggggctgtggctccggctgtggaggctgtggctccggctgtgggggctgtggctccggctgtgggggctgtgggggatgtggctccggctgctgtgtgcctgtctgctgctgcaagcccatgtgctgctgtgtgccagcttgttcctgctccagctgtggcaaagggggctgtggctcttgcgggggctccaagagaggctgtgtctcctgtggggtgtccaagggggcctgtggctcctgtggggggtccaaggggggctgtggctcctgtggggggtccaaggggggctgtggctcctgtggggggtccaaggggggctgtggttcttatggctgctcccagtgcagctgctgtaagccctgctgctgctcctcaggctgtgggtcatcctgctgccagtccagctgctgtaagccttactgctgccagtccagctgctgtaagccctgtagctgcttctcaggctgtggatcatcctgctgccaatccagctgctacaagccctgctgctgccagtccagctgctgtgtccccgtgtgctgccagtgtaagatctgaggctctgactgcagactgcaggtggcctgactggtgaagggcccgtctgcccagcttccttgccctgggttctctggtgctccactgtctccactgtgtcctcactggcttcatccactccacaccagtgcttccgaaactgactgaggaccc

SEQ ID NO: 145653 - DNA, 561 bp, Homo sapiens
  Payload ID: 8870
  Gene Symbol: KRTAP5-6
  Gene Name: keratin associated protein 5-6
  Uniprot ID: Q6L8G9
  ENST ID: ENST00000382160
  CDS Start-End: 52-441
cctccctctcacctgctcctctacctgctccaccctcaatccaccagaaccatgggctgctgtggctgctctggaggctgtggctccggctgtgggggctgtggctctggctgtgggggctgtgggtccagctgctgtgtgcccatctgctgctgcaagcccgtgtgctgctgtgtgccagcctgttcctgcaccagctgtggctcttgtgggggctccaaggggtgctgtggctcttgtgggggctccaaagggggctgtggctcttgtgggggctccaagggaggctgtggctcttgtggctgctcccagtgcagttgctgcaagccctgctactgttcctcaggctgtgggtcatcctgctgccagtccagctgctgcaagccctgctgttcccaggccagctgctgtgtccccatttgctgccagtgcaaaatctgaggctctgactttggacctcaggtgagtccagcatatccacaccacccaagaagtgaccagtgctgcatttcagttctggctgtcccacagctccaggagttgtgtcccctgaattttgca

SEQ ID NO: 145654 - DNA, 561 bp, Homo sapiens; identical to SEQ ID NO: 145653
  Payload ID: 8870
  Gene Symbol: KRTAP5-6
  Gene Name: keratin associated protein 5-6
  Uniprot ID: Q6L8G9
  ENST ID: ENST00000611731
  CDS Start-End: 52-441

SEQ ID NO: 145655 - DNA, 1408 bp, Homo sapiens
  Payload ID: 8871
  Gene Symbol: KRTAP5-7
  Gene Name: keratin associated protein 5-7
  Uniprot ID: Q6L8G8
  ENST ID: ENST00000398536
  CDS Start-End: 35-532
cctctacctgctccaccctcaatccaccagaaccatgggctgctgtggctgttccgaaggctgtggctccggctgtgggggctgtggctccggctgtgggggctgtggctctggctgtgggggatgtggctccagctgctgtgtgcccgtctgctgctgcaagcccgtgtgctgctgtgtgccagcctgttcctgctccagctgtggctcctgtgggggctccaagggaggctgtggctcctgtgggggctccaaggggggctgtggctcttgtgggggttctaaggggggctgtggttcttgtggctgctcccagtgcagctgctataagccctgctgctgctcctcaggctgtgggtcatcctgctgccagtccagctgctgtaagccctgctgctgccagtccagctgctgtaagccctgctgctgttcctcaggctgtgggtcatcctgctgccagtccagttgctgcaatccctgctgctcccagtctagctgctgtgtccccgtgtgctgccagtgtaagatctgaggctctggactcaggtctcatgtgagtcctgctaaccccattttccgaagctgtgacctgtccttcatcgttgagccccaaaccactgctcagggtccattcctcactataagatgaagccatatctgcctgccttttcctaaggagagtccaccctaattaatgtccattccctcctaacaaattctcttcccaagtcaactgcaactgcggctgaatcacccctcacccgctagccttgcctttgcttgtgtattcagaggcctgagctcctgaacccacttgaagtcctgtcttttccagctggagcagctgggcatgagtgtcccacctgcaacaaggtgggcgtttaagaggcttccttggagtggctttgcctgtccaacactctgctttatcttaaatgaaaagttgcaaactaataaaaataccatgccgacaaactgaaacacatatcttgctgatttctctgttgttcggggtcattactatggctatggctattgttttcttgttcttgttgtgtttcggactgcgtgggtctgatgctgatgttgctggaaggtgctaggatggggctggctgtctcctctgcctctcatctccttcctggctgacccctcttttctcagaacccctctcttcctaggtctttccagctattgatctgatggagacaggactgttcctcaggccagggccacagaagcagaagaggctgctgaaaactctggggagttcagacttgcctcctttccctggtccaggcctctgccatcttcctttgggaagtttttgtaaccaacttactctgattgtctttgttgttacacagcctgttgcctctgtaaataaacactcctagcaccaagccaa

SEQ ID NO: 145656 - DNA, 1183 bp, Homo sapiens
  Payload ID: 8872
  Gene Symbol: KRTAP5-8
  Gene Name: keratin associated protein 5-8
  Uniprot ID: O75690
  ENST ID: ENST00000398534
  CDS Start-End: 32-595
ctacctgctccaccctcaacccaccagaaccatgggctgctgtggctgctctggaggctgtggctccggctgtgggggctgcggctctggctgtgggggatgtggctctagctgctgtgtgcccatctgctgctgcaagcccgtgtgctgctgtgtgccagcctgttcctgctccagctgtggctcctgtgggggctccaaggggggccgtggctcctgtgggggctccaagggggactgtggctcctgtgggggctccaagggaggctgtggttcttgtggctgctcccagtgcagctgctataagccctgctgttgctcctcaggctgtgggtcatcctgctgccagtccagctgctgcaaaccctgctgttcccagtccagctgttgtaagccctgcagctgctcttcaggctgtgggtcatcctgctgccagtccagctgctgcaagccctgctgttcccagtccagctgctgtaagccctgctgctgctcttcaggctgtgggtcatcctgctgccagtccagctgctgcaagccctgctgttcccagtccagctgctgtgtcccaatttgctgccagtgcaagatctgaggctctgcctacaaatctcagctggtcccacagatctgggctctccaggaatgactgtagctgtgtcctgaattcctgaagcacatctctgagtctgtcctcctctggactaaggcagcctagcgtccagggctcagtactcagctgctcagcctctgaggtcatgagggcttctggcatgctgggtgctgcccatcaaccctcccagaatcccctcttcctttcctgacctcatcacttcaaccttctcagggcttcaagatcccacatccctgggcccctcctgtgagcctgctggaaacacactgaaactggaatcctccgacctgctgccgcctctccccggtccctgcaacctcctggctcctccacccttcatcttcatcctgcctgagctgccacagctccgattgtttttggagttgacctagaggactcagaattattagagaccccaggatcctctcctgaggaggaggggcgcccagtctcctcttctacctctgacctggccttgtttctttccccagggcttcgccttgtaagtgcctaggctgaatcttctaaataaatacgatccacacctcc

SEQ ID NO: 145657 - DNA, 1136 bp, Homo sapiens
  Payload ID: 8873
  Gene Symbol: KRTAP5-9
  Gene Name: keratin associated protein 5-9
  Uniprot ID: P26371
  ENST ID: ENST00000528743
  CDS Start-End: 241-750
atgaattccacaaggaaatcatctcaggaggaagggctcatacttggatccagaaaatatcaacatagccaaagaaaaacaatcaagacatacctccaggagctgtgtaacagcaaccggaaagagaaacaatggtgtgttcctatgtgggatataaagagccggggctcagggggctccacacctgcacctccttctcacctgctcctctacctgctccaccctcaatccaccagaaccatgggctgctgtggctgctccggaggctgtggctccagctgtggaggctgtgactccagctgtgggagctgtggctctggctgcaggggctgtggccccagctgctgtgcacccgtctactgctgcaagcccgtgtgctgctgtgttccagcctgttcctgctctagctgtggcaagcggggctgtggctcctgtgggggctccaagggaggctgtggttcttgtggctgctcccagtgcagttgctgcaagccctgctgttgctcttcaggctgtgggtcatcctgctgccagtgcagctgctgcaagccctactgctcccagtgcagctgctgtaagccctgttgctcctcctcgggtcgtgggtcatcctgctgccaatccagctgctgcaagccctgctgctcatcctcaggctgtgggtcatcctgctgccagtccagctgctgcaagccctgctgctcccagtccagatgctgtgtccctgtgtgctaccagtgcaagatctgaggctctagtgggaaacctcaggtagctcctgaagatctgtgctttccaacaagtgactacccttgaagcacatccccttctggatctgaaaagagcccttggctcagggcgtctttttccagcccctgaggaaatggaatgaaccactccctgcccattccctataagaatatcccaagacccaggcaattttgcccctctttcccacatgcccccatatgtctgagccaaactgcactgggggctgccctcatgccaagcaagagcctggaattccccttcttgataattccatgggagacagcaaacccttctttcctttgcctgccaggagcttcacgacatttgcagatggatgtcctgcaacccaaatgatcacatgtatc

SEQ ID NO: 145658 - DNA, 500 bp, Homo sapiens
  Payload ID: 8874
  Gene Symbol: KRTAP6-1
  Gene Name: keratin associated protein 6-1
  Uniprot ID: Q3LI64
  ENST ID: ENST00000329122
  CDS Start-End: 27-242
caaggacaacctccacaaccaacaccatgtgtggcagctactacggaaactactatggcacccctggctatgggttctgtggctatggaggcctgggctatggctatggaggcctgggctgtggctatggctcctgctgtggctgtggcttccgcagactgggctgtggctatggctatggctcccgctccctctgtggctatggctatggatgcggctctggctctggctactattattgaggatgccatgggagactctcaccctctatcctgtgatactgagattcactaattctgaagcccacatgttctgagattttcccttgagtgatgatatcctgcaatggaagtctaatatggtctgttgttgagctaccatctaacctacaaatatcttgaatttccatcatgaaacgggataaggtaaaattcacctgtcagttctcctttcatcagaatgatggtgtcacatcatctgccttgatgacttttatgatg

SEQ ID NO: 145659 - DNA, 313 bp, Homo sapiens
  Payload ID: 8875
  Gene Symbol: KRTAP6-2
  Gene Name: keratin associated protein 6-2
  Uniprot ID: Q3LI66
  ENST ID: ENST00000334897
  CDS Start-End: 29-217
cccaaggacaacctccacaaccatcacgatgtgcggcagctactacggaaactactacggcgaccatggctatgggtgctgtggatacgaaggcctaggctatggctatggaagcctgcgctgtggctatagctcctgctgtggctatggtcatggctacggctcccgcttcttctgtggctgtggctatggatgcggctctggctactactattgaggacaccgtgggagactcatcctctatcctgtgacatcgggattcaccaattctgaaccccgtatgctctgagctcggggctggatgaagattatc

SEQ ID NO: 145660 - DNA, 636 bp, Homo sapiens
  Payload ID: 8876
  Gene Symbol: KRTAP6-3
  Gene Name: keratin associated protein 6-3
  Uniprot ID: Q3LI67
  ENST ID: ENST00000391624
  CDS Start-End: 7-339
ccaaggatgacctcaacaaccaacaccatgtgtggcagctactacagaaactacaatggtggccatggctatgggtgctgtggctacggaggcctgggctgtggttatggcggctgtggctatgggtgctgtggctacggaggcctgggctttggctatggaggcctggactgtggctatggaggcctgggctgtggctatggctccttctgtggctgtggctacagaggcctggactgtggctatggctgtggctatggctatgtctcccactccttctgtggctgtggctataggtgcggctctggctatggctccagctttggctactactattgaggacaccatgggagactctcaccctctatcctgtgacattgcaattcaccaattctgaagcccacatgctctgagcctttcccttgattgatgatatcctgcagtggaagtctaatatgatctgttgttgatctaccatctaacccaaaaataccctgagtttccatcatgaagtgggataaggtgaagttcacctgtcacttctccttttatcaggatgatggtgtcacagtgactcctttgatgactttcatgctgtagtttgtttctctgctgacctaataaacacatttaatc

SEQ ID NO: 145661 - DNA, 721 bp, Homo sapiens
  Payload ID: 8877
  Gene Symbol: KRTAP7-1
  Gene Name: keratin associated protein 7-1 (gene/pseudogene)
  Uniprot ID: Q8IUC3
  ENST ID: ENST00000621162
  CDS Start-End: 62-325
attaacacttgggtaacttacccttcacaatccatctaaatccttctcaattgctgccaccatgactcgttacttctgctgtggaagctacttcccaggataccctatctatgggaccaacttccatgggaccttcagagccacccccttgaactgtgttgtgcctctgggctctcccctgaactatggctgtggatgcaatggctacagctccctgggctacagctttggtggtagcaacatcaacaacctgggcggctgctatggtggtagcttctataggccatggggctctggctctggctttggctacagcacctactgatggaccaatggctccagtgactacaggactctcaattaattctctgcacagaacaacctgaagagcaatgactgtcttcctaccttcccatgtgcttgggtgatacatcttccatcttcttgctgacttcttgctgtggtctttgtctttgatgctgttggacaagtcacccaggactcaggtgctgaactgatactcatctacagacaaaggaagcaagatgcatttttttggtcatacttgaattttaacagtgaaaaagtagtttgcctcccatggttgctctgctcatgtattattagcttctacatcaacattaatgtattacaaattgggtgtgggtagtaaggggattttctgtcagtctcttaataaatctatttccttcagcataaa

SEQ ID NO: 145662 - DNA, 556 bp, Homo sapiens
  Payload ID: 8878
  Gene Symbol: KRTAP8-1
  Gene Name: keratin associated protein 8-1
  Uniprot ID: Q8IUC2
  ENST ID: ENST00000329621
  CDS Start-End: 33-224
tgttgctacctaagccctccactcccgacaccatgctctgcgacaacttccccggggctgtcttcccaggatgctactggggcagctatggctacccgctgggatatagcgttggctgtggctatggcagcacctactctccagtgggctatggcttcggctatggctacaacggctgtggggctttcggctacaggagatactcgccatttgctctctactgattggctgaaatccccgaggtgtagcatcttctctcccttgaaggctgagccccacatctccaggttccccccgtatccactccttcagtcctcatttgctcatcaacctcagagacactgctttccaacttacctcgagtcccaggggaggaaaatgaaaaagcagacgcttcctcaagctgcctcccctggctgatgttctctgggacattttcggaaatttgacctcccacttgtcatgagctacttttgaattttccatgacactcatgacttgtgatgaagtcatggatatgtctatcaaaatctcaataaatttgtctcagctggta

SEQ ID NO: 145663 - DNA, 753 bp, Homo sapiens
  Payload ID: 8879
  Gene Symbol: KRTAP9-1
  Gene Name: keratin associated protein 9-1
  Uniprot ID: A8MXZ3
  ENST ID: ENST00000398470
  CDS Start-End: 1-753
atgacccactgctgttccccttgctgtcagcctacatgctgcaggaccacctgctgcaggacaacctgctggaagcccaccactgtgaccacctgcagcagcacaccctgttgccagccctcctgctgtgtgcccagctgctgccagccttgctgccacccaacttgctgtcaaaacacctgctgcaggaccacctgctgccagcccacttgtgtggccagctgctgccagccttcctgctgcagcacaccctgctgccagcccacctgctgtgggtccagctgctgtggccaaaccagctgtgggtccagctgctgtcagcctatttgtgggtccagttgctgtcagccttgctgtcacccgacttgctatcaaactatctgcttcaggaccacctgctgccagcctacctgctgccagcccacctgctgcaggaacacctcttgccagcccacctgctgtgggtccagctgctgccagccttgctgccacccaacatgctgtcaaaccatttgtagatccacctgctgccaaccatcctgtgtgaccagatgctgcagcacaccctgttgccagccaacctgtggtgggtccagctgctgtagccaaacctgcaatgagtccagctattgtctgccttgctgccgtcccacctgctgccagaccacctgctacaggaccacctgttgccgccccagctgttgctgcagtccttgctgtgtctccagctgctgccagccttcctgctgctaa

SEQ ID NO: 145664 - DNA, 351 bp, Homo sapiens
  Payload ID: 8879
  Gene Symbol: KRTAP9-1
  Gene Name: keratin associated protein 9-1
  ENST ID: ENST00000634235
  CDS Start-End: 1-351
tgctgccacccaacttgctgtcaaaacacctgctgcaggaccacctgctgccagcccacttgtgtggccagctgctgccagccttcctgctgcagcacaccctgctgccagcccacctgctgtgggtccagctgctgtgggaccacctgctgccagcctacctgctgccagcccacctgctgcaggaacacctcttgccagcccacctgctgtgggtccagctgctgccagcctccttgctgccgtcccacctgctgccagaccacctgctacaggaccacctgttgccgccccagctgttgctgcagtccttgctgtgtctccagctgctgccagccttcctgctgctaa

SEQ ID NO: 145665 - DNA, 369 bp, Homo sapiens
  Payload ID: 8879
  Gene Symbol: KRTAP9-1
  Gene Name: keratin associated protein 9-1
  ENST ID: ENST00000635603
  CDS Start-End: 1-369
tgctgtcagcctacatgctgcaggaccacctgctgcaggccctcctgctgtgtgcccagctgctgccagccttgctgccacccaacttgctgtcaaaacacctgctgcaggaccacctgctgccagcccacttgtgtggccagctgctgccagccttcctgctgcagcacaccctgctgccagcccacctgctgtgggtccagctgctgtggccaaaccagctgtgggtccagctgctgtcagcctatttgtgggtccagttgctgtcagccttgctgtcacccgaccacctgctgccagcctacctgctgccagcccacctgctgcaggaacacctcttgccagcccacctgctgtgggtccagctgc

SEQ ID NO: 145666 - DNA, 330 bp, Homo sapiens
  Payload ID: 8879
  Gene Symbol: KRTAP9-1
  Gene Name: keratin associated protein 9-1
  ENST ID: ENST00000634358
  CDS Start-End: 1-330
tgtcagcctacatgctgcaggaccacctgctgcaggacaacctgctggaagcccaccactccctcctgctgtgtgcccagctgctgccagccttgctgccacccaacttgctgtcaaaacacctgctgcaggaccacctgctgccagcccacttgtgtggccagctgctgccagccttcctgctgcagcacaccctgctgccagcccacctgctgtggccaaacctgcaatgagtccagctattgtctgccttgctgccgtcccacctgctgccagaccacctgctacaggaccacctgttgccgccccagctgttgctgcagtccttgc

SEQ ID NO: 145667 - DNA, 1005 bp, Homo sapiens
  Payload ID: 8880
  Gene Symbol: KRTAP9-2
  Gene Name: keratin associated protein 9-2
  Uniprot ID: Q9BYQ4
  ENST ID: ENST00000377721
  CDS Start-End: 8-532
tgacaccatgacccactgttgctccccttgctgtcagcctacctgctgcaggaccacctgctgcaggaccacctgctggaagcccaccactgtgaccacctgcagcagcacaccctgctgccagcccgcctgctgtgtgtccagctgctgccagccttgctgccgcccaacttgctgtcaaaacacctgctgtaggaccacctgctgccagcccacctgtgtgaccagctgctgccagccttcctgctgcagcacaccctgctgccagcccacctgctgtgggtccagctgctgtggccaaaccagctgtgggtccagctgtggccagagcagctcctgtgcacctgtgtactgcagaagaacctgctactaccccacgactgtctgcctgcctggttgcctaaaccagagctgtggctccaactgctgccagccctgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctgttctcaagtttgagtcatggtctcagctttgactctaaagtcaagagcttcattccctgcttctaaggaatttaggtttctgcaactgatcgatgatctttgcaatcttttttttgttttcaatatcctcctcatcgttcttgtatccttctttcttcttttcatgataaatttgtgttgtgtccctggtagcagaaatccttacctatatgtttctgaataaattctgaaccatcctcatctca

SEQ ID NO: 145668 - DNA, 1005 bp, Homo sapiens
  Payload ID: 8880
  Gene Symbol: KRTAP9-2
  Gene Name: keratin associated protein 9-2
  Uniprot ID: Q9BYQ4
  ENST ID: ENST00000572513
  CDS Start-End: 8-532
tgacaccatgacccactgttgctccccttgctgtcagcctacatgctgcaggaccacctgctgcaggaccacctgctggaagcccaccactgtgaccacctgcagcagcacatcctgctgccagcccgcctgctgtgtgtccagctgctgccagccttgctgccgcccaacttcctgtcaaaacacctgctgtaggaccacctgctgccagcccacctgtgtgaccagctgctgccagccttcctgctgcagcacaccctgctgccagcccacctgctgtgggtccagctgctgtggccaaaccagctgtgggtccagctgtggccagagcagctcctgtgcacctgtgtactgcagaagaacctgctactaccccacgactgtctgcctgcctggttgcctaaaccagagctgtggctccaactgctgccagccgtgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctgttctcaagtttgagtcatggtctcagctttgactctaaagtcaagagcttcattccctgcttctaaggaatttaggtttctgcaactgatcgatgatctttgcaatcttttttttgttttcaatatcctcctcatcgttcttgtatccttctttcttcttttcatgataaatttgtgttgtgtccctggtagcagaaatccttacctatatgtttctgaataaattctgaaccatcctcatctca

SEQ ID NO: 145669 - DNA, 1005 bp, Homo sapiens
  Payload ID: 8880
  Gene Symbol: KRTAP9-2
  Gene Name: keratin associated protein 9-2
  ENST ID: ENST00000571104
  CDS Start-End: 8-532
tgacaccatgacccactgttgctccccttgctgtcagcctacctgctgcaggaccacctgctgcaggaccacctgctggaagcccaccactgtgaccacctgcagcagcacaccctgctgccagcccgcctgctgtgtgtccagctgctgccagccttgctgccgcccaacttgctgtcaaaacacctgctgtaggaccacctgctgccagcccacctgtgtgaccagctgctgccagccttcctgctgcagcacaacctgctgccagcccacctgctgtgggtccagctgctgtggccaaaccagctgtgggtccagctgtggccagagcagctcctgtgcacctgtgtactgcagaagaacctgctactaccccacgactgtctgcctgcctggttgcctaaaccagagctgtggctccaactgctgccagccgtgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctgttctcaagtttgagtcatggtctcagctttgactctaaagtcaagagcttcattccctgcttctaaggaatttaggtttctgcaactgatcgatgatctttgcaatcttttttttgttttcaatatcctcctcatcgttcttgtatccttctttcttcttttcatgataaatttgtgttgtgtccctggtagcagaaatccttacctatatgtttctgaataaattctgaaccatcctcatctca

SEQ ID NO: 145670 - DNA, 720 bp, Homo sapiens
  Payload ID: 8880
  Gene Symbol: KRTAP9-2
  Gene Name: keratin associated protein 9-2
  ENST ID: ENST00000615963
  CDS Start-End: 28-492
agaagcccaccctccacccctgacaccatgacccactgttgctccccttgctgtcagcctacatgctgcaggaccacctgctgcaggaccacctgctggaagcccaccactgtgaccacctgcagcagcacatcctgctgccagcccgcctgctgtgtgtccagctgctgccagccttgctgccgcccaacttcctgtcaaaacacctgctgccagcccatctgtgtgaccagctgctgccagccttcctgctgtagcacaccctgctgccagcccacatgctgtgggtccagctgtggtcagagcagctcctgtgcacctgtgtactgcagaagaacctgctaccaccccacaactgtctgcctgcctggttgcctaaaccagagctgtggctccagctgctgccagccctgctgccgcccagcctgctgtgagaccacttgcttccagcccacctgtgtgtacagctgctgccagccttcttgctgctgatcaagtcccaagagaaccaccatactcacacaacaaatttctgctcaactgactcatcttttgggggactaatttaatttgctgctgacagccaccatgctttcacccaaatttttatgaattctctgcatgtttaaaatcttgtgaatcagcctgagggagggcagaatacttcatcttgattctctttttccttacaccttgtggatcatgtgccagcttcgtctg

SEQ ID NO: 145671 - DNA, 992 bp, Homo sapiens
  Payload ID: 8881
  Gene Symbol: KRTAP9-3
  Gene Name: keratin associated protein 9-3
  Uniprot ID: Q9BYQ3
  ENST ID: ENST00000411528
  CDS Start-End: 40-519
tcacctcttaacagaagcccaccctccatccctgacaccatgacccactgttgctccccttgctgtcagcctacctgctgcaggaccacctgctggcagcccaccactgtgaccacctgcagcagcacaccctgctgtcagccctcctgctgtgtttccagctgctgccagccttgctgccacccaacttgctgtcaaaacacctgctgtaggaccacctgctgccagcccatctgtgtgaccagctgctgccagccttcctgctgtagcacaccctgctgccagcccacatgctgtgggtccagctgtggtcagagcagctcctgtgcacctgtgtactgcagaagaacctgctaccaccccacaagtgtttgtctgcctggttgcctaaaccagagctgtggctccaactgctgccagccctgctgccgcccagcctgctgtgagaccacctgctgcaggaccacttgtttccagcccacctgtgtgtacagctgctgccagccttcttgctgctaatcaactcccaagagaactaccatcctcacacaacaaccttcagctcaactgacttgtcttttgagggactaatttactttgctgctgacagccaccatgctctcacccaaatttttatgaattctctacatgtttaaaatcttgggaatctgcttgagggagggcagaatacttcatcctcattccctctttccttacaccttgtggatcatgtgccagcttcgtctgttcttaatttggagtcatgatctcagctttgtctcaaaaatcaagagcttcattctttgcttctaaggaatttaggtttctgcaactgatcaatcatctttgcaattatattttcattttaaatatccttctcatggttcttgtatccttctttcttcttttcacgataactttgggttatgtctctggtagcagagattcttacctatatgtttctgaataaactctgaaccatcttcatctca

SEQ ID NO: 145672 - DNA, 992 bp, Homo sapiens
  Payload ID: 8881
  Gene Symbol: KRTAP9-3
  Gene Name: keratin associated protein 9-3
  Uniprot ID: Q9BYQ3
  ENST ID: ENST00000571096
  CDS Start-End: 40-519
tcacctcttaacagaagcccaccctccatccctgacaccatgacccactgttgctccccttgctgtcagcctacctgctgcaggaccacctgctggcagcccaccactgtgaccacctgcagcagcacaccctgctgccagccctcctgctgtgtttccagctgctgccagccttgctgccacccaacttgctgtcaaaacacctgctgtaggaccacctgctgccagcccatctgtgtgaccagctgctgccagccttcctgctgtagcacaccctgctgccagcccacatgctgtgggtccagctgtggtcagagcagctcctgtgcacctgtgtactgcagaagaacctgctaccaccccacaagtgtttgtctgcctggttgcctaaaccagagctgtggctccaactgctgccagccctgctgccgcccagcctgctgtgagaccacctgctgcaggaccacttgtttccagcccacctgtgtgtacagctgctgccagccttcttgctgctaatcaactcccaagagaactaccatcctcacacaacaaccttcagctcaactgacttgtcttttgagggactaatttactttgctgctgacagccaccatgctctcacccaaatttttatgaattctctacatgtttaaaatcttgggaatctgcttgagggagggcagaatacttcatcctcattccctctttccttacaccttgtggatcatgtgccagcttcgtctgttcttaatttggagtcatgatctcagctttgtctcaaaaatcaagagcttcattctttgcttctaaggaatttaggtttctgcaactgatcaatcatctttgcaattatattttcattttaaatatccttctcatggttcttgtatccttctttcttcttttcacgataactttgggttatgtctctggtagcagagattcttacctatatgtttctgaataaactctgaaccatcttcatctca

SEQ ID NO: 145673 - DNA, 967 bp, Homo sapiens
  Payload ID: 8882
  Gene Symbol: KRTAP9-4
  Gene Name: keratin associated protein 9-4
  Uniprot ID: Q9BYQ2
  ENST ID: ENST00000334109
  CDS Start-End: 35-499
tctgaacagaagcccaccctctacccctgacaccatgacccactgttgctccccttgctgtcagcctacatgctgcaggaccacctgctgcaggaccacctgctggaagcccaccactgtgaccacctgcagcagcacaccctgctgccagccctcctgctgtgtttccagctgctgccagccttgctgccgcccaacttgctgtcaaaacacctgctgccagcccacctgtgtgaccagctgctgccagccttcctgctgcagcacaccctgctgccagcccacctgctgtgggtccagctgtgaccagagcagctcctgtgcacctgtgtactgcagaagaacctgctactaccccacaactgtctgcctgcctggttgcctaaaccagagctgtggctccaactgctgccagccctgctgccgcccagcctgctgtgagaccacttgcttccagcccacctgtgtgtccagctgctgtcagcctttttgctgctgatcaagtcccaagagaaccaccatcctcacacaacaactttctgctcaactgacttatcttttgggggactaatttaatttgctgctgacagccaccatgctctcacccaaatttttatgaattctctacctgtttaaaatcttgggaatctacttgagggagggcagaatacttcatcctgattctctttttccttacactttgtggatcatgtgccagcttcgtgtgttctcaattttgagtcatggtctcagctttgactcaaaagtcaagagcttcattctctgcttctaaggaatttaggtttctgcaactgatcaataatctttgcaatcatatttttgttttcaatatcctcctcatggttcttgtatccttctttcttcttttcataactttgggttatgtttctgctaccagcagagattcttagctatatgtttctgaataaactctgaaccatcctca

SEQ ID NO: 145674 - DNA, 967 bp, Homo sapiens
  Payload ID: 8882
  Gene Symbol: KRTAP9-4
  Gene Name: keratin associated protein 9-4
  Uniprot ID: Q9BYQ2
  ENST ID: ENST00000575341
  CDS Start-End: 35-499
tctgaacagaagcccaccctccacccctgacaccatgacccactgttgctccccttgctgtcagcctacatgctgcaggaccacctgctgcaggaccacctgctggaagcccaccactgtgaccacctgcagcagcacaccctgctgccagccctcctgctgtgtgtccagctgctgccagccttgctgccgcccaacttgctgtcaaaacacctgctgccagcccacctgtgtgaccagctgctgccagccttcctgctgcagcacaccctgctgccagcccacctgctgtgggtccagctgtgaccagagcagctcctgtgcacctgtgtactgcagaagaacctgctactaccccacaactgtctgcctgcctggttgcctaaaccagagctgtggctccaactgctgccagccctgctgccgcccagcctgctgtgagaccacttgcttccagcccacctgtgtgtacagctgctgtcagcctttttgctgctgatcaagtcccgagagaaccaccatcctcacacaacaactttctgctcaactgacttatcttttgggggactaatttaatttgctgctgacagccaccatgctctcacccaaatttttatgaattctctacatgtttaaaatcttgggaatctgcttgagggagggcagaatacttcatcctgattctctttttccttacactttgtggatcatgtgccagcttcgtgtgttctcaattttgagtcatggtctcagctttgactcaaaagtcaagagcttcattctctgcttctaaggaatttaggtttctgcaactgatcaataatctttgcaatcatatttttgttttcaatatcctcctcatggttcttgtatccttctttcttcttttcataactttgggttatgtttctgctaccagcagagattcttagctatatgtttctgaataaactctgaaccatcctca

SEQ ID NO: 145675 - DNA, 967 bp, Homo sapiens
  Payload ID: 8882
  Gene Symbol: KRTAP9-4
  Gene Name: keratin associated protein 9-4
  Uniprot ID: Q9BYQ2
  ENST ID: ENST00000570861
  CDS Start-End: 35-499
tctgaacagaagcccaccctctacccctgacaccatgacccactgttgctccccttgctgtcagcctacatgctgcaggaccacctgctgcaggaccacctgctggaagcccaccactgtgaccacctgcagcagcacaccctgctgccagccctcctgctgtgtttccagctgctgccagccttgctgccgcccaacttgctgtcaaaacacctgctgccagcccacctgtgtgaccagctgctgccagccttcctgctgcagcacaccctgctgccagcccacctgctgtgggtccagctgtgaccagagcagctcctgtgcacctgtgtactgcagaagaacctgctactaccccacaactgtctgcctgcctggttgcctaaaccagagctgtggctccaactgctgccagccctgctgccgcccagcctgctgtgagaccacttgcttccagcccacctgtgtgtccagctgctgtcagcctttttgctgctgatcaagtcccaagagaaccaccatcctcacacaacaactttctgctcaactgacttatcttttgggggactaatttaatttgctgctgacagccaccatgctctcacccaaatttttatgaattctctacctgtttaaaatcttgggaatctgcttgagggagggcagaatacttcatcctgattctctttttccttacactttgtggatcatgtgccagcttcgtgtgttctcaattttgagtcatggtctcagctttgactcaaaagtcaagagcttcattctctgcttctaaggaatttaggtttctgcaactgatcaataatctttgcaatcatatttttgttttcaatatcctcctcatggttcttgtatccttctttcttcttttcataactttgggttatgtttctgctaccagcagagattcttagctatatgtttctgaataaactctgaaccatcctca

SEQ ID NO: 145676 - DNA, 1303 bp, Homo sapiens
  Payload ID: 8883
  Gene Symbol: KRTAP9-6
  Gene Name: keratin associated protein 9-6
  Uniprot ID: A8MVA2
  ENST ID: ENST00000391355
  CDS Start-End: 40-522
tcacctctgaacagaagcccaccctccacccctgacaacatgacccactgttgctcccctggctgtcagcctacctgctgcaggaccacttgctgcaggactacctgctggcagcccaccattgtgaccacctgcagcagcacaccctgctgccagccctcctgctgtgtgtccagctgctgccagccttactgccacccaacttgctgtcaaaacacctgctgcaggaccacctgctgccagcccacctgtgtgaccagctgctgccagccttcctgctgcagcacaccctgctaccagcccatctgctgtgggtccagctgctgtggccaaaccagctgtgggtccagctgtggccagagcagctcctgtgcacctgtgtactgcagaagaacctgctaccaccccacgactgtctgcctgcctggttgcctcaaccagagctgtggatccagctgctgccagccctgctactgcccagcctgctgtgtgtccagctgctgccagcattcttgttgctgagcagcaccacagaggaccatcatcctcacacaacaaccttctgctcaactgaccttttttttcttttgagacggagcctcactgtcacccaggctggagtgcagtagcacgctctcggctcgctgcaacctccatcttctgggttcaagtgattctcctgcctcagcctcctgagtagctgggattacatgcctgtgccaccacgcctggctaattttttgtatttttagtatttttagtagttttcaccatgttgatcagacttgtctggaactcctgccctcaggtgatccacctgcctcagcctcccaaagtgctgggattacaggtgtgagctaccacacccagacccaactcacttatctttcagaagacagatttactttcaaactttactgatacacagtatgctttcaccaattttttttatttctttgcctgtttaaaatcttgggaatcagcttgagggagggcagaatacttcatcctgattcttttttccttacactttgtggatcatgtgccagcttcatgtgttctcaatgtggagacatggtctccattcgactctaaagtcaagagcttcattctctccttctaagaaacttaggtttctgcaactgatcaataatctttgcaatcatatttttgttttcaattttgtcctcatgtttcttttacccttctttcttcttttcattgtaactttgggctatgtccctagtagcagggattcttacctatatatttctgaataaattctgaaccatccttcatctca

SEQ ID NO: 145677 - DNA, 525 bp, Homo sapiens
  Payload ID: 8883
  Gene Symbol: KRTAP9-6
  Gene Name: keratin associated protein 9-6
  ENST ID: ENST00000574248
  CDS Start-End: 1-525
atgacccactgttgctcccctggctgtcagcctacctgctgcaggaccacttgctgcaggactacctgctggcagcccaccattgtgaccacctgcagcagcacaccctgctgccagccctcctgctgtgtgtccagctgctgccagccttgctgccacccaacttgctgtcaaaacacctgctgcaggaccacctgctgccagcccacctgtgtgaccagctgctaccagccttcctgctgcagcacaccctgctgccagcccatctgctgtgggtccagctgctgtggccaaaccagctgtgggtccagctgctgccagcccagctcctgtgcacccatctactgcaggagaacctgctaccaccccacgagtgtctacctgcctggttgcctaaaccagagctgtggctccagctgctgccagccgtgctgccgcccagcctgctgtgagactacctgctgcaggaccacttgcttccagcccacctgtgtgaccagctgctgtcagcctgcttgctgctga

SEQ ID NO: 145678 - DNA, 1303 bp, Homo sapiens; identical to SEQ ID NO: 145676
  Payload ID: 8883
  Gene Symbol: KRTAP9-6
  Gene Name: keratin associated protein 9-6
  Uniprot ID: A8MVA2
  ENST ID: ENST00000576511
  CDS Start-End: 40-522

SEQ ID NO: 145679 - DNA, 1039 bp, Homo sapiens
  Payload ID: 8884
  Gene Symbol: KRTAP9-7
  Gene Name: keratin associated protein 9-7
  Uniprot ID: A8MTY7
  ENST ID: ENST00000391354
  CDS Start-End: 40-549
tcacctctgaacagaagtccaccctccacccctgacaccatgacccactgttgctccccttgctgtcagcctacctgctgcaggaccacctgctggaagcccaccactgtgaccacctgcagcagcacaccctgctgccagccctcctgctgtgtgtccagctgctgccagccttgctgccacccaacttgctgtcaaaacacctgctgcaggaccacctgctgccagcccacctgtgtgaccagctgctgccagccttcctgctgcagcacaccctgctgccagcccatctgctgtgggtccagctgctgtggccaaaccagctgtgggtccagctgctgccagcccagctcctgtgcacccatctactgcaggagaacctgctaccaccccacgagtgtctacctgcctggttgcctaaaccagagctgtggctccagctgctgccagccgtgctgccgcccagcctgctgtgagactacctgctgcaggaccacttgcttccagcccacctgtgtgaccagctgctgtcagcctgcttgctgctgatcagttccgcagaggaccatcatccccatacagtaaccctctggcaaaagatttaccttctgggggacaaatttactttcaaactgtgatgaaaaccaacaaagtgaacttagggtgaactttgctcaccctaatttttatgacttctctgcatgtttaacattttgtgaatcagcttgagtgagggtagagtacttcatcctgattcttttttccttacaccttgtggatcatgtgccaccttcatgtattttcaatttggagtcatggtctcagcttgactctaaagtcaagagcttcattccctttctctaagaaacttaggttttgcaactgatcaataatcttcacaatcatgttttcattttcagtgtcctcctcgtggttcttttatccttattcctttcatgatcattttgggttatctccctagaaacagggactcttacctatatgtttcttaataaactcaaagctgtccttcatctca

SEQ ID NO: 145680 - DNA, 1039 bp, Homo sapiens; identical to SEQ ID NO: 145679
  Payload ID: 8884
  Gene Symbol: KRTAP9-7
  Gene Name: keratin associated protein 9-7
  Uniprot ID: A8MTY7
  ENST ID: ENST00000573531
  CDS Start-End: 40-549

SEQ ID NO: 145681 - DNA, 960 bp, Homo sapiens
  Payload ID: 8885
  Gene Symbol: KRTAP9-8
  Gene Name: keratin associated protein 9-8
  Uniprot ID: Q9BYQ0
  ENST ID: ENST00000254072
  CDS Start-End: 8-487
tgacaccatgacccactgttgttccccttgctgtcagcctacgtgctgcaggaccacctgctggaagcccaccactgtgaccacctgcagcagcacaccctgctgccagccctcctgctgtgtgtccagctgctgccagccttgctgccgcccaacttgctgtcaaaacacctgctgccagcccatctgtgtgaccagctgctgccagccttcctgctgcagcacaccctgctgtcagcccacctgctgtggccaaaccagctgtgggtccagctgtggtcagagcagctcctgtgcacctgtgtactgcagaagaacctgctaccaccccacgactgtctgcctgcctggttgcctaaaccagagctgtggctccaactgctgccagccctgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctgttctcaagtttgagtcatggtctcagctttgactctaaagtcaagagcttcattccctgcttctaaggaatttaggtttctgcaactgatcgatgatctttgcaatcttttttttgttttcaatatcctcctcatcgttcttgtatccttctttcttcttttcatgataaatttgtgttgtgtccctggtagcagaaatccttacctatatgtttctgaataaattctgaaccatcctcatctca

SEQ ID NO: 145682 - DNA, 750 bp, Homo sapiens
  Payload ID: 8885
  Gene Symbol: KRTAP9-8
  Gene Name: keratin associated protein 9-8
  ENST ID: ENST00000622336
  CDS Start-End: 28-522
agaagcccaccctccatccctgacaccatgacccactgttgctccccttgctgtcagcctacctgctgcaggaccacctgctgcaggaccacctgctggaagcccaccactgtgaccacctgcagcagcacaccctgctgccagccctcctgctgtgtgtccagctgctgccagccttgctgccgcccaacttgctgtcaaaacacctgctgccagcccatctgtgtgaccagctgctgccagccttcctgctgcagcacaccctgctgtcagcccacctgctgtggccaaaccagctgtgggtccagctgtggtcagagcagctcctgtgcacctgtgtactgcagaagaacctgctaccaccccacgactgtctgcctgcctggttgcctaaaccagagctgtggctccaactgctgccagccctgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctg

SEQ ID NO: 145683 - DNA, 981 bp, Homo sapiens
  Payload ID: 8886
  Gene Symbol: KRTAP9-9
  Gene Name: keratin associated protein 9-9
  Uniprot ID: Q9BYP9
  ENST ID: ENST00000394008
  CDS Start-End: 3-512
ccatgacccactgttgctccccttgctgtcagcctacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgaccagctgctgccagccttcctgctgcagcacaacctgctgccagcccatctgctgtgggtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatgtgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacctatatatttcttaataaataaatttggaactattattcata

SEQ ID NO: 145684 - DNA, 981 bp, Homo sapiens
  Payload ID: 8886
  Gene Symbol: KRTAP9-9
  Gene Name: keratin associated protein 9-9
  Uniprot ID: Q9BYP9
  ENST ID: ENST00000570825
  CDS Start-End: 3-512
ccatgacccactgttgctccccttgctgtcagcctacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgaccagctgctgccagccttcctgctgcagcacaacctgctgccagcccatctgctgtgggtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatgtgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacatatatatttcttaataaataaatttggaactattattcata

SEQ ID NO: 145685 - DNA, 986 bp, Homo sapiens
  Payload ID: 8886
  Gene Symbol: KRTAP9-9
  Gene Name: keratin associated protein 9-9
  ENST ID: ENST00000592900
  CDS Start-End: 1-525
atgacccactgttgctccccttgctgtcagcctacctgctgcaggaccacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgaccagctgctgccagccttcctgctgcagcacaacctgctgccagcccatctgctgtgggtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatctgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacctatatatttcttaataaataaatttggaactat

SEQ ID NO: 145686 - DNA, 933 bp, Homo sapiens
  Payload ID: 8886
  Gene Symbol: KRTAP9-9
  Gene Name: keratin associated protein 9-9
  Uniprot ID: Q9BYP9
  ENST ID: ENST00000618683
  CDS Start-End: 3-467
ccatgacccactgttgctccccttgctgtcagcctacctgctgcaggaccacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatgtgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacctatatatttcttaataaataaatttggaactattattc

SEQ ID NO: 145687 - DNA, 933 bp, Homo sapiens
  Payload ID: 8886
  Gene Symbol: KRTAP9-9
  Gene Name: keratin associated protein 9-9
  ENST ID: ENST00000617040
  CDS Start-End: 3-467
ccatgacccactgttgctccccttgctgtcagcctacctgctgcaggaccacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatctgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacctatatatttcttaataaataaatttggaactattattc

SEQ ID NO: 145688 - DNA, 650 bp, Homo sapiens
  Payload ID: 8886
  Gene Symbol: KRTAP9-9
  Gene Name: keratin associated protein 9-9
  ENST ID: ENST00000610858
  CDS Start-End: 29-553
cagaagcccaccctctacccctgacaccatgacccactgttgctccccttgctgtcagcctacatgctgcaggaccacctgctgcaggaccacctgctggaagcccaccactgtgaccacctgcagcagcacaccctgctgccagccctcctgctgtgtttccagctgctgccagccttgctgccgcccaacttgctgtcaaaacacctgctgcaggaccacctgctgccagcccacctgtctgaccagctgctgccagccttcctgctgcagcacaacctgctgccagcccatctgctgtgggtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaacca

SEQ ID NO: 145689 - DNA, 981 bp, Homo sapiens
  Payload ID: 8886
  Gene Symbol: KRTAP9-9
  Gene Name: keratin associated protein 9-9
  ENST ID: ENST00000610933
  CDS Start-End: 3-512
ccatgacccactgttgctccccttgctgtcagcctacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgaccagctgctgccagccttcctgctgcagcacaacctgctgccagcccatctgctgtgggtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatctgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacctatatatttcttaataaataaatttggaactattattcata

SEQ ID NO: 145690 - DNA, 525 bp, Homo sapiens
  Payload ID: 8886
  Gene Symbol: KRTAP9-9
  Gene Name: keratin associated protein 9-9
  ENST ID: ENST00000611783
  CDS Start-End: 25-504
aacccaccctccacccctgacaccatgacccactgttgctccccttgctgtcagcctacctgctgcaggaccacctgctggaagcccaccactgtgaccacctgcagcagcacaccctgctgccagccctcctgctgtgtgtctagctgctgccagccttgctgccgcccagcttgctgtcaaaacacctgcttccagcccacctgtgtgtccagctgctgccagccttcttgctgcagcacaccctgctgccagtccagctgctgtggccaaaccagctgtgggtccagctgtggccagagcagctcctgtgcacctgtgtactgcagaagaacctgctaccaccccacgactgtctgcctgcctggttgcctaaatcagagctgtggctccagctgctgccagccctgctgccgcccagcctgctgtgagaccacctgctgcaggaccacttgcttccagcccacttctgtgatcagctgctgtcagccttcttgctgctgaccaactctccagaggaccacc

SEQ ID NO: 145691 - DNA, 933 bp, Homo sapiens
  Payload ID: 8886
  Gene Symbol: KRTAP9-9
  Gene Name: keratin associated protein 9-9
  Uniprot ID: Q9BYP9
  ENST ID: ENST00000617021
  CDS Start-End: 3-467
ccatgacccactgttgctccccttgctgtcagcctacctgctgcaggaccacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatgtgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacatatatatttcttaataaataaatttggaactattattc

SEQ ID NO: 145692 - DNA, 2502 bp, Homo sapiens
  Payload ID: 8887
  Gene Symbol: RP5-1028K7.3
  Gene Name: Keratin-like protein KRT222
  ENST ID: ENST00000476049
  CDS Start-End: 43-930
atcgataaggttcagttagccaaggtggaggatgggaaaagaatggaactgtcccagctactcaatgagatcagggcaaactatgaaaagatcctcaccagaaatcagatagagacggtgctctcaacaaggatccagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaattaaccacaggtcagggatcccatacgttcattctccctccacagtgacccacaatatccatcgggtgtttatgtatccaaagaagaggctactcattccatctggtaaaccaacatactcatgatttagtggaaagagccctggagtggcacagagggctgcctcaatacacacttactgagcgtctaacaatgaatgggtcaagcccttcgtaggcactggcaatgggaagatgaccaatacagacggctgaaccttgctttcaaggccttcataaagcactggagatgacaaacacggtccgatacaaagggtcgggttcaggactccaaccattattatcaaagagccacgggaatacaaaggaaggattactaggggggaagttccaggagggcatcacaaagagacctctgagctggatccagaaggacagatgagtttaagctgaaagtggggacggtcgttcccgctggtgggaaccgaaggagccgaggcagcgctgaggcggagaccagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgag

SEQ ID NO: 145693 - DNA, 552 bp, Homo sapiens
  Payload ID: 8888
  Gene Symbol: KRTCAP2
  Gene Name: keratinocyte associated protein 2
  Uniprot ID: Q8N6L1
  ENST ID: ENST00000295682
  CDS Start-End: 32-520
ggagtagcaagtccgcggtaagcgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 145694 - DNA, 872 bp, Homo sapiens
  Payload ID: 8889
  Gene Symbol: KRTCAP3
  Gene Name: keratinocyte associated protein 3
  Uniprot ID: Q53RY4
  ENST ID: ENST00000288873
  CDS Start-End: 33-755
acagcggccctgcggctggcgcggcggacgggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacagcaggtgctgttccgagactcagtcctaaagggttttttttcccactaagcaaggggccctgacctcgggatgagataacaaattgtaataaagtaacttctcttttcttcta

SEQ ID NO: 145695 - DNA, 942 bp, Homo sapiens
  Payload ID: 8889
  Gene Symbol: KRTCAP3
  Gene Name: keratinocyte associated protein 3
  Uniprot ID: Q53RY4
  ENST ID: ENST00000407293
  CDS Start-End: 160-828
ttccgggccctggcgtctcgtctccttaccctggggctacccttgccccgtcctactgcccgcggttaacccgccgcgagccgcctctcccctccccgcccgactcaaccctgccctcccccgtgctttgcagacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtgctgttccgagactcagtcctaaagggttttttttcccactaagcaaggggccctgacctcgggatgagataacaaattgtaataaagtaacttctcttttcttcta

SEQ ID NO: 145696 - DNA, 373 bp, Homo sapiens
  Payload ID: 8889
  Gene Symbol: KRTCAP3
  Gene Name: keratinocyte associated protein 3
  ENST ID: ENST00000452499
  CDS Start-End: 1-189
gctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtagtagctgggtgtgacgcaagagtgaaacagaaagcctggcagccacggtttcctgggattaaagtcaaagcattatgaatatggcactaaagtgactgagctaccagaccaatgatcctgtaaggcagccacagaactaaaaaacaacaattattattaaactgctctggattctc

SEQ ID NO: 145697 - DNA, 665 bp, Homo sapiens
  Payload ID: 8889
  Gene Symbol: KRTCAP3
  Gene Name: keratinocyte associated protein 3
  ENST ID: ENST00000453171
  CDS Start-End: 16-222
ggcgcggcggacgggatgaggcgctgcagtctctgcgctttcgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtgctgttccgagactcagtcctaaagggttttttttcccactaagcaaggggccctgacctcgggatgagataacaaattgtaataaagtaacttctcttttcttc

SEQ ID NO: 145698 - DNA, 956 bp, Homo sapiens
  Payload ID: 8889
  Gene Symbol: KRTCAP3
  Gene Name: keratinocyte associated protein 3
  Uniprot ID: Q53RY4
  ENST ID: ENST00000543753
  CDS Start-End: 48-770
gggccgggcccaggtacagcggccctgcggctggcgcggcggacgggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacaggtagtagctgggtgtgacgcaagagtgaaacagaaagcctggcagccacggtttcctgggattaaagtcaaagcattatgaatatggcactaaagtgactgagctaccagaccaatgatcctgtaaggcagccacagaactaaaaaacaacaattattattaaactgctctggattctcaa

SEQ ID NO: 145699 - DNA, 1793 bp, Homo sapiens
  Payload ID: 8890
  Gene Symbol: KDF1
  Gene Name: keratinocyte differentiation factor 1
  Uniprot ID: Q8NAX2
  ENST ID: ENST00000320567
  CDS Start-End: 90-1286
gagcggcgagggggcgggggaggggctgagccggaggcggctcacctggcgggacaggtgcctggctgctacaaaccatgcaatgagccatgccccgccctggacacccccgcccagcatctgggcctccacgcttgggaccgtgggagcggccaacagagctatgtctggagacatatgataaaccacctcagcccccaccaagccgccgcacccgtagaccagaccccaaggaccctggccaccatgggccagagagcattaccttcatctctggctctgctgagccggcccttgagtcccccacctgctgcctgctctggcgaccctgggtgtgggagtggtgccgggctgccttctgcttccgccgctgccgggattgcctccagcgctgtggagcctgtgtgcggggatgcagcccctgcctgtctactgaggactccactgaggggactgctgaagccaactgggccaaggagcacaatggagtgccccccagccctgatcgtgcaccccccagccggcgggatggccagcggctcaagtcaaccatgggcagcagcttcagctaccccgatgttaagctcaaaggcatccctgtgtatccctacccgagggccacctccccagcccctgatgcggactcctgctgcaaggagccactggccgatcccccacccatgcgacacagcctgcccagcacctttgccagtagtcctcgtggctccgaggagtactattctttccatgagtcggacctggacctgccggagatgggcagtggctccatgtcgagccgagaaattgatgtgctcatcttcaagaagctgacagagctgttcagcgtacaccagatcgatgagctggccaagtgcacatcagacactgtgttcctggagaagaccagtaagatctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatgagctgacagtgcagatctcccaggagacgactgcagatgccatcgcccggaagctgaggccttatggagctccagggtacccagcaagccatgactcatccttccagggcaccgacacagactcgtcgggggcacccttgctccaggtgtactgctaacccctgccaggcccagctgccacaccctttctgggagaagcatggcctacagaatgaagagggggaccaggaacccctgtgggagaggcttagacctgaagcagtgcccactctggctcctcctgccttggctgactgggttcctggaccatgtgcatttcactgggccatgggatctacatctccttgcatccccagctggtctgatccctgccagggccccttccttcctgctcatggtcttcaggtggcctgatcatggaaagtaaggagttaggcattaccttctgggagtgaaccctgactccatccccctattgccaccctaaccaatcatgcaaacttctccctccctggggtaattcaacagttaaaagaagcttatcttaaatgtattgtattggggggtgggcagggcccactctatgttatgttaaggagttggttctggttcttggctgatgttctgtatcttaacatgaccacagtttgtaagtacaaaggtaa

SEQ ID NO: 145700 - DNA, 1651 bp, Homo sapiens
  Payload ID: 8890
  Gene Symbol: KDF1
  Gene Name: keratinocyte differentiation factor 1
  ENST ID: ENST00000616918
  CDS Start-End: 69-692
ggggctgagccggaggcggctcacctggcgggacaggtgcctggctgctacaaaccatgcaatgagccatgccccgccctggacacccccgcccagcatctgggcctccacgcttgggaccgtgggagcggccaacagagctatgtctggagacatatgataaaccacctcagcccccaccaagccgccgcacccgtagaccagaccccaaggaccctggccaccatgggccagagagcattaccttcatctctggctctgctgagccggcccttgagtcccccacctgtctactgaggactccactgaggggactgctgaagccaactgggccaaggagcacaatggagtgccccccagccctgatcgtgcaccccccagccggcgggatggccagcggctcaagtcaaccatgggcagcagcttcagctaccccgatgttaagctcaaaggcatccctgtgtatccctacccgagggccacctccccagcccctgatgcggactcctgctgcaaggagccactggccgatcccccacccatgcgacacagcctgcccagcacctttgccagtagtcctcgtggctccgaggagtactattctttccatgagtcggacctggacctgccggagatgggcagtggctccatgtcgagccgagaaattgatgtgctcatcttcaagaagctgacagagctgttcagcgtacaccagatcgatgagctggccaagtgcacatcagacactgtgttcctggagaagaccagtaagatctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatgagctgacagtgcagatctcccaggagacgactgcagatgccatcgcccggaagctgaggccttatggagctccagggtacccagcaagccatgactcatccttccagggcaccgacacagactcgtcgggggcacccttgctccaggtgtactgctaacccctgccaggcccagctgccacaccctttctgggagaagcatggcctacagaatgaagagggggaccaggaacccctgtgggagaggcttagacctgaagcagtgcccactctggctcctcctgccttggctgactgggttcctggaccatgtgcatttcactgggccatgggatctacatctccttgcatccccagctggtctgatccctgccagggccccttccttcctgctcatggtcttcaggtggcctgatcatggaaagtaaggagttaggcattaccttctgggagtgaaccctgactccatccccctattgccaccctaaccaatcatgcaaacttctccctccctggggtaattcaacagttaaaagaagcttatcttaaatgtattgtattggggggtgggcagggcccactctatgttatgttaaggagttggttctggttcttggctgatgttctgtatcttaacatgaccacagtttgtaagtacaaagg

SEQ ID NO: 145701 - DNA, 491 bp, Homo sapiens
  Payload ID: 8891
  Gene Symbol: KRTDAP
  Gene Name: keratinocyte differentiation-associated protein
  Uniprot ID: P60985
  ENST ID: ENST00000338897
  CDS Start-End: 90-389
gggaccccatttctgtgctcatctgcctccttggcaatataaagagcaagcactgaggccccgcctcagagcaccccaaacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaa

SEQ ID NO: 145702 - DNA, 451 bp, Homo sapiens
  Payload ID: 8891
  Gene Symbol: KRTDAP
  Gene Name: keratinocyte differentiation-associated protein
  Uniprot ID: P60985
  ENST ID: ENST00000484218
  CDS Start-End: 90-347
gggaccccatttctgtgctcatctgcctccttggcaatataaagagcaagcactgaggccccgcctcagagcaccccaaacttgacgccatgaagatcccggtccttcctgccgtggtgctcctctccctcctggtgctccactctgcccagggagccaccctgggtggtcctgaggaagaaagcaccattgagaattatgcgtcacgacccgaggcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaaca

SEQ ID NO: 145703 - DNA, 2492 bp, Homo sapiens
  Payload ID: 8892
  Gene Symbol: KPRP
  Gene Name: keratinocyte proline-rich protein
  Uniprot ID: Q5T749
  ENST ID: ENST00000606109
  CDS Start-End: 29-1768
gtcactcttgactggctgcatcaggaccatgtgtgaccagcagcagatccagtgccgcctgccgctccaacagtgctgcgtcaagggtccctccttctgctcctctcaatccccctttgcccagagccaagtggtggttcaagccccttgtgagatgcaaattgtggactgccctgcatcatgcccagttcaagtttgccaggtgtcagaccaggctccatgccagtctcagaccacacaggtgaagtgccagtctaagaccaagcaggtgaagggccaggctcaatgtcagtctaagaccacccaggtgaagggccaggctgcatcccaatctcaaacttcctctgttcaaagccaggctccatgccaatctgaggtgtcctacgtgcagtgcgaagcgtcacaacctgttcagacttgcttcgtagaatgtgctccagtttgttatacagaaacttgttatgtagaatgcccagtccagaactatgtaccctgtccagctcctcagcctgtccagatgtatagagggcgtcctgcagtgtgccagcctcagggaagattctccacccagtgccagtatcaaggctcctatagcagttgtggcccccagtttcagtcaagggctacctgcaacaactacaccccccagttccagttgaggccttcctacagcagctgtttccctcagtatcggtcccggacttcatttagtccctgtgtgccccagtgccagacccagggctcctatgggagcttcactgaacagcaccgctctcggagcaccagcagatgccttcctcctcctcggcggctgcagcttttcccccgcagctgttccccaccaagacgttttgagccctgctccagcagctacctgccactaagaccctctgaaggtttccctaactactgcaccccaccccgccgctctgaacccatatataacagtcgctgtcctcgccgccccatttcaagctgctctcagagacgtggccccaagtgccgaatcgagatttcctccccgtgctgccccaggcaggttcccccacagaggtgtcctgttgagattcctcccatcagacgccgctcccagagctgtggcccgcagccctcctggggcgcctcctgccctgagctgaggccacacgtagagccacgtccactcccaagcttctgtccaccacggcgtcttgaccagtgtccagagtcaccactgcagcgatgtccacctcctgctccacgtccacgtctgcgcccagaaccatgcataagtctagaaccacgcccgcgtcctctaccacgacaactttcagaaccttgtttgtatccagaaccacttccagcactacgtccaacaccgcggccagttccccttcctcgcccagggcagtgtgagattccagagccacgtccatgcctgcagccctgtgagcacccagagccttgtccacgaccagagccaattcccctgccggcgccctgcccaagcccggagccctgcagggagacttggcgcagccccagcccatgctggggcccaaatccagttccatacccaggagacctaggctgtcatgagtctagtccacaccgcctagacaccgaagctccctactgtggcccatccagttacaaccaggggcaagagagtggtgctggctgtgggcctggtgatgtgtttccagagcggaggggtcaggatggccatggagaccaaggcaatgcctttgctggagtgaaaggggaagcaaagagtgcttatttttaaaggaaaggtgactgagataaccctctctcctgctctgaaaatgttgttcctcctattccacaatttccagtacgctcttgtttgaatctctccaaagatattcagagactccctattacgaaggtgatgtccaaactcctttgcctatcatccaaagatccacacctgggtctcagatgcctctccagcctcacgtgtcactcctcgcccgtacgcatcctcggctctagccagaccagtctggccactgggcacagcttgggtgttccccaggccatactttagatgtccctgcctccaagcctctgctcactcttccccactctgcctggaccacttctctcctcctccccagcttctgaaatccaccccatctttcagtgcctctcccttggagccttctttgcttgttcccactcacaagaacctgtgccgacttcctagaactcactgcatcccccgcactacttggtaactgcctggtgacatctcttgaattgttatttcactttgcaggcatgtcttccttatctgcccaactaggttgtaaactcccaactgagtggagtcggagaatctctaaatctcagtgtctatcctggggctggctgttgcttagcaaggcttgtgggttggcagcttgaaccatgttctgtcctgatgctcaactgcaggaactgaggtgagaggaggccatgtgacaataaagatcattatgtactca

SEQ ID NO: 145704 - DNA, 2162 bp, Homo sapiens
  Payload ID: 8893
  Gene Symbol: KERA
  Gene Name: keratocan
  Uniprot ID: O60938
  ENST ID: ENST00000266719
  CDS Start-End: 249-1307
gaagaagatccaagaaggctgaggtaagcagtcttctgaagccctgtcaaagtggaaacaatagatcaaaggtgttcatggtgactgggacgagtaggtttcactgtttctcatagacgacttgacagcttaaagtaaaaacaaattattttcgtcaaagtttttttttttctcttaactgatttttagcaaacctcagactgagacacaggactcaacggtgtattcctggaaggcaaggtgctataatggcaggcacaatctgtttcatcatgtgggtgttattcataacagacactgtgtggtctagaagtgtgaggcaggtctatgaagtacatgattcagatgattggactattcatgacttcgagtgtcccatggaatgtttctgcccacccagttttcctactgctttatattgtgaaaatagaggtctcaaagaaattcctgctattccttcaagaatttggtatctttatcttcaaaacaacctgatagaaaccattcctgaaaagccatttgagaatgccacccagctaagatggataaatctaaacaagaacaaaataaccaactacggaattgaaaaaggagccctaagccagctgaagaagttgctcttcttatttctggaagataatgagctagaggaggtaccttctccattgccaagaagtttagaacaattacaattagctagaaataaggtgtccagaattcctcaagggacctttagcaatctggagaacctgacccttcttgacctacagaacaacaaattagtggacaatgcctttcaaagagacacttttaaaggactcaagaatctcatgcagctaaacatggccaagaatgccctgaggaatatgcctccaagattaccagccaatacaatgcagttgtttttagacaacaattccattgaaggaataccagaaaattattttaatgtgattcctaaagtggcctttttgagactaaatcacaacaaactgtcagatgagggtctcccatcaagaggatttgatgtatcatcaattctagatcttcaactgtcgcacaatcaactcacaaaggttccccgaatcagtgctcatctgcagcaccttcaccttgatcataacaaaattaaaagtgtgaatgtctctgtaatatgtcccagcccatccatgctgcctgcagaacgagattccttcagttatggacctcatcttcgctacctccgtctggatggaaatgaaatcaaaccaccaattccaatggctttaatgacctgcttcagacttctgcaggctgtcattatttaaacacattctcaccaaatctaaaattagtttaatgagctgtttctgacatgaaatgtggttaccattaataggtttaggacacaagtcatattccccattgctctcggccaccattttcatttgtgcagtgtattttttctattcaaagatgcttttgccagttacatgcatcacagcctgcattaatttgcttttcttttaattaataaaacagacacagagttaagatagtttatcaactcaaagatagttttattttggtctcttccatagcttattaacactaaagaaaacaattacattcttatacaataaaaaggacacatttgtgtatgtttaaaattacttatgcagataccgtaatttacagtataaatgtaataatcaaacaggaggataacgacctgaagaaaatgagaaaataaaatatttcttaattgtaatcataataaaacaattgcagattgctaagtagctgttggtggtacaagtttgatatttagcttgagaatgggtatggaatgaatcaaatacttcatcactaaagaattcttgttatttaatatcaaataatgaaacagcagtcacttctagttcattaccatttcttgtagctgttgtttttagatatagtccactgcattcttataagttctaaattttatgtttattataatgcatttcttgtggaatcttagtgttttaacatttgaaatccacttaaactgcaaattgttctttatatttgattgtgttttttggattttctaaataaaaatattgaatgctttctaacaaaacagaatatttcaaagaaattagcaagcttcattaaagaacatgttttaataaaaa

SEQ ID NO: 145705 - DNA, 2397 bp, Homo sapiens
  Payload ID: 8894
  Gene Symbol: KHK
  Gene Name: ketohexokinase (fructokinase)
  Uniprot ID: P50053
  ENST ID: ENST00000260598
  CDS Start-End: 479-1375
gcagatgcgaggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgacttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattaaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctc

SEQ ID NO: 145706 - DNA, 2411 bp, Homo sapiens
  Payload ID: 8894
  Gene Symbol: KHK
  Gene Name: ketohexokinase (fructokinase)
  Uniprot ID: P50053
  ENST ID: ENST00000260599
  CDS Start-End: 514-1410
cggggccgccgcgaccgcgggcttcaggcagggctgcagatgcgaggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattaaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatg

SEQ ID NO: 145707 - DNA, 1303 bp, Homo sapiens
  Payload ID: 8894
  Gene Symbol: KHK
  Gene Name: ketohexokinase (fructokinase)
  ENST ID: ENST00000429697
  CDS Start-End: 467-1303
cccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacagcttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggc

SEQ ID NO: 145708 - DNA, 6725 bp, Homo sapiens
  Payload ID: 8895
  Gene Symbol: KHNYN
  Gene Name: KH and NYN domain containing
  Uniprot ID: O15037
  ENST ID: ENST00000251343
  CDS Start-End: 140-2176
gggagagaaaggagggatgaagccgcctgcccactggacgggagggctgcagccagagcttcagggcagccctgctggatgggacagcactgagggctggacctggggggatggagaacatgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggattgggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacgtgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagcggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgctcattgtaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaactgggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccacgacctacttaggctacaatttcctttaaggcagcccctagctctgggaaggaatactggtagccagtggccagtgttcgctgtgggatcaccttctggccctccagcagcatgatggcacgctgtcgcccaaagacagcttgcaccacagcgctggggagagggatgaaggctcggcggcccagggcagcacccaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcctctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcctcaccttctctggcccttaggatctccccatttggagacagagccatttggatattttccccttgaacttctccatgacctgaagcgttccttccctggaggaactctggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttcaaatagtggctggtgtgtataattgtttgcaattacttggtcccaaaggtgaccaggaactctgttcctaaagaactatggtgtgagaagtaagggactttgggataggtggacttttccctggcattgagtgatgccactccccactgttttttcagggtctcaatttcttagtgaaagtacacaaaggttaggagaaacatgcatggatcaagggcctaggaagtcattttgcctggaaaagaccagtgctctggtgtgtgcatagctacagaggtctgagttaccccgttcccctggcgaatataaggggctggtgatttggggggcgtacctacacctgtgactaagacccaggccttggggggttgtggggctttggtgatggctttagccagcaattgggtggtctctaggcggctgccgattacctctttttggaaggtttcattccatctgcaggagaaacatgggaaataaaaagccactaaatac

SEQ ID NO: 145709 - DNA, 3359 bp, Homo sapiens
  Payload ID: 8895
  Gene Symbol: KHNYN
  Gene Name: KH and NYN domain containing
  Uniprot ID: O15037
  ENST ID: ENST00000553935
  CDS Start-End: 200-2236
aagtgactcaagaaacagtttgcgtgcgatgtggacaagagaggtccccgctgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggattgggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacgtgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgcttta

SEQ ID NO: 145710 - DNA, 911 bp, Homo sapiens
  Payload ID: 8895
  Gene Symbol: KHNYN
  Gene Name: KH and NYN domain containing
  ENST ID: ENST00000556510
  CDS Start-End: 508-911
cccggcccggcccctgggccctgggcggtgctcctggcccgacggagaggggcagcggacggctgggggaggggtgggagtggcttgaaccttggaaatggcagaccagggcccccagaggacagcctagttcaatcccctgctgaggattcgtccttaagaagcttcagagtgccccaggagactccttctggcctccaggccgagctggagcccccccacccttcttgctccggactgtggtcatccttttccaaagcccagacgcccactctcgatagacagccttgtttaccgggacttcctctccggagaggcctgcgtgacatacaccctccctacctccagtggactcagatgcttgtcacctcctggggctgtttaccagagccttaactaggtgcgacctgttgatagctggtgtagtcccaggaaccaggatttggatggagggtacaatgaggctctgagctgccttctccccttccagggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggt

SEQ ID NO: 145711 - DNA, 2443 bp, Homo sapiens
  Payload ID: 8895
  Gene Symbol: KHNYN
  Gene Name: KH and NYN domain containing
  Uniprot ID: O15037
  ENST ID: ENST00000556842
  CDS Start-End: 75-2111
aggaagtgactcaagaaacagtttgcgtgcgatgtggacaagagaggtccccgctggggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggattgggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggca

SEQ ID NO: 145712 - DNA, 760 bp, Homo sapiens
  Payload ID: 8895
  Gene Symbol: KHNYN
  Gene Name: KH and NYN domain containing
  ENST ID: ENST00000554268
  CDS Start-End: 249-620
ccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacagacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttggg

SEQ ID NO: 145713 - DNA, 1018 bp, Homo sapiens
  Payload ID: 8896
  Gene Symbol: KHDC3L
  Gene Name: KH domain containing 3-like, subcortical maternal complex member
  Uniprot ID: Q587J8
  ENST ID: ENST00000370367
  CDS Start-End: 54-707
tcggcctttgggtttgctgtggtgtccttgtctcctgcaggaccggccgcagcatggacgctcccaggcggtttccgacgctcgtgcaactgatgcagccaaaagcaatgccagtggaggtgctcggtcacctccctaagcggttctcctggttccactctgagttcctgaagaatccgaaggtagttcgccttgaggtttggctggtggaaaagatcttcggccggggcggagaacgcatcccgcacgtccagggtatgtcccaaatcttgattcacgtgaatcgattggaccctaacggcgaggctgagatcttggtatttgggaggccttcttaccaggaggacacaatcaagatgatcatgaacctggctgactatcaccgccagctccaggcgaaaggctcaggaaaggccctcgcccaggatgtcgccactcagaaggccgagacccagcggtcttcaatagaagtccgggaggccgggacgcagcgttcggtggaggtccgggaggccgggacccagcgttcggtggaagtccaggaggtcgggacacagggttctccggtggaggtgcaggaggccgggacccagcagtctctccaggctgccaacaagtcggggacccagcgatcccccgaagctgccagcaaggcagtgacccagcggtttcgcgaggatgcccgggacccagttactagattatgaaggcatctcaggccctggagccagagccagtcaggggttaaagtgaaagcccgtatttccgcccagaagctggggttggggagaggatgtggattttttgttttaccctttctgttgcatggttgcaaacacaaacttgagttctaataaagaattgcaaagtggaagcccgccccccgcctcccccccgcctcacttaagtccaggaagctggggtggcgaggaaggatgatgtggattgtttttgttttacaccttctgttgaatggttgccaacacaaacttgagttctaataaataattgcatttcc

SEQ ID NO: 145714 - DNA, 2757 bp, Homo sapiens
  Payload ID: 8897
  Gene Symbol: KHDRBS1
  Gene Name: KH domain containing, RNA binding, signal transduction associated 1
  Uniprot ID: Q07666
  ENST ID: ENST00000327300
  CDS Start-End: 168-1499
gctggctgcgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatcaaagtaaa

SEQ ID NO: 145715 - DNA, 1215 bp, Homo sapiens
  Payload ID: 8897
  Gene Symbol: KHDRBS1
  Gene Name: KH domain containing, RNA binding, signal transduction associated 1
  Uniprot ID: Q07666
  ENST ID: ENST00000492989
  CDS Start-End: 1-1215
atgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaa

SEQ ID NO: 145716 - DNA, 2332 bp, Homo sapiens
  Payload ID: 8898
  Gene Symbol: KHDRBS2
  Gene Name: KH domain containing, RNA binding, signal transduction associated 2
  Uniprot ID: Q5VWX1
  ENST ID: ENST00000281156
  CDS Start-End: 280-1329
gcgtcctgttcccgcctctccagttaaggccgctggtgtgagccggggctctgcgcgagcgagggacgacggaagggacgggcaggtgtgggcgcggggccacgcagcccgacggcgggagtcgcaggtgctgggtgcatgggccagtgaggacgcacagagatccctcgccgcgcggaggaggagcagcgcgggagccaggcgctgccccaagaccctgcctgcgtccgagcgagcggaacctcgcgcttcgcccggggacaatccgaagtccgcgctatggaagaggagaaatatttgcctgagctgatggcagagaaagatagcctggatccatcttttgtgcatgcgtcgcgccttttggcagaagaaattgaaaagtttcaaggttctgatggaaaaaaggaagacgaagaaaagaagtatcttgatgtcatcagcaacaaaaacataaagctctcagaaagagtactgattcctgtcaagcagtatccaaagttcaattttgtggggaaattgcttggaccaagaggaaactccttgaagaggctacaggaagaaacaggtgctaaaatgtctatcctgggcaaaggatcaatgagagataaagctaaggaagaagaactaaggaagagtggggaagccaaatatgcccacttgagtgatgagcttcatgtattaattgaagtgtttgctccacctggggaagcttattcacgtatgagtcatgcattggaagagattaaaaaattcctggttcctgactacaatgatgaaattcgtcaggaacaactacgtgaattatcttacttaaatggctcagaggactctggtcgtggcagaggtattagaggcagagggatcagaatagctcccacagctccttcaaggggccgtgggggtgccattcctcctcccccaccacctggacgaggtgttctcacccctcggggaagcactgtaacccgtggagcgcttccagtgccacctgtagcaagaggtgtccctacccctcgagcccggggggcaccaacagtgccaggatacagggcacctcctcctccagcccatgaagcttatgaagaatatggttatgatgatggctacgggggtgaatatgatgaccagacctatgagacttatgataacagctatgcgacccaaacacaaagtgtgcctgaatactatgactacggtcatggagtaagtgaggatgcctatgacagctacgcaccagaagaatgggccacaacccgctctagcttgaaggcaccaccgcaaaggtcagccagagggggatacagggaacacccctatggtagatattgaaggtccttcccacctgtgacctcacctcaaagacaattcatagcctgtggtctccacataaacagcaacaagacaagtaatagtcctttttttgtttgtttgtttctattctagggataactgctcatgattactcccatatatttctagtatttccctctgtactgttggcgtgacattgacactagtattattttacaaaacagactgaaaaagacattagcaagcatagtctataaacctttcagtaggatgatattctcttggttgtttttcattgttgtgtgtaatcttttttttttctttttcttttttttttttttgaggaaaagcatgaatttgttaacagattttgagtctcaaccaactagcagaaactttgtttagggttgctaaaagactgtaatatgatttttgaactagctgataataaagttgtagataagatgttttaacctgtcttttaatatctgttagttagacaaagatgtttgatattaagtttgtaaatttaattttaatgctgttttaatggggttgaaaacaagcagctactgtatgtatgtagctaactgaatttgttcagtgttttaacctgtatttgttaaaaaagaaaaaaaaacacacataaagttccatgtgtaagcttctctaaataggaaaccacaatttgtcaaatatgtttgccataatttgtcaataaagctgaaaacttttgtaaaaattaaatttggaattacttgttttctagctttaaatgcctgctttatttcttcttcaagagatgcctaaaatgttttctatttaaaaattacaaaaatgaacccaagtctgttttaagatatttgtgtaatacttaaaaatgtattaataacttatggttgttaaataatttaaaagttaacaaactaaactgttacatgaatcatggttagtaaacactaatgtataacatgttaatggaaaaaaatggatttagaataataaatggattttaaactat

SEQ ID NO: 145717 - DNA, 1977 bp, Homo sapiens
  Payload ID: 8899
  Gene Symbol: KHDRBS3
  Gene Name: KH domain containing, RNA binding, signal transduction associated 3
  Uniprot ID: O75525
  ENST ID: ENST00000355849
  CDS Start-End: 411-1451
gagtgcgcggggcggcgcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcagaatgcttaaaatctgaatggatggaacttaaaactactttgttgaaacatcaacctgggcagaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaaa

SEQ ID NO: 145718 - DNA, 585 bp, Homo sapiens
  Payload ID: 8899
  Gene Symbol: KHDRBS3
  Gene Name: KH domain containing, RNA binding, signal transduction associated 3
  ENST ID: ENST00000524282
  CDS Start-End: 1-585
gtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatggcaagaagagtggactaactcaagacacaaggc

SEQ ID NO: 145719 - DNA, 1066 bp, Homo sapiens
  Payload ID: 8899
  Gene Symbol: KHDRBS3
  Gene Name: KH domain containing, RNA binding, signal transduction associated 3
  ENST ID: ENST00000517859
  CDS Start-End: 1-589
tttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatattggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcagaatgcttaaaatctgaatggatggaacttaaaactactttgttgaaacatcaacctgggcagaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtt

SEQ ID NO: 145720 - DNA, 1243 bp, Homo sapiens
  Payload ID: 8899
  Gene Symbol: KHDRBS3
  Gene Name: KH domain containing, RNA binding, signal transduction associated 3
  ENST ID: ENST00000520981
  CDS Start-End: 358-717
cctgtgtccaggctccaacagccctggcggggcagtcagccctcccaggggatgggcagcccatgccaagccttgcaggctggcccttggagaagtcagtaggggagaagaggccggcaaaagagcaccgttccggagggcgttgggttgggtgaccctcattggtggctggcttgaggttcggaatagtggtgaagggagtccttgccattttcacacgactccagccagctcagggtgtgaaagatcctaggaagtactgcgggtcagggatacagagatttctggaggcacgcctacccgggacagtgttcccctggctttttcctcctgtggcttcctgaatcatctgctggcatgcacgaaatagaaaagtttcaaaaaggagaaggcaaggatgaagaaaagtacatcgatgtggtgattaataagaacatgaagctgggacagaaagtgttaattcccgtaaaacagttccctaaggactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcagaatgcttaaaatctgaatggatggaacttaaaactactttgttgaaacatcaacctgggcagaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaaa

SEQ ID NO: 145721 - DNA, 793 bp, Homo sapiens
  Payload ID: 8899
  Gene Symbol: KHDRBS3
  Gene Name: KH domain containing, RNA binding, signal transduction associated 3
  ENST ID: ENST00000521461
  CDS Start-End: 1-179
ataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagaaatgtcagccatcttggaatgtcacaggaactggttgaacacctgaagcaaacaaaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatttgtatagtagttaataaaggctgcctattgaaatctcttctactttaaacctagaaaaacaaagtcttgttatttcagcacagctctaaattgtatacacttgaaaaccatgtacagctgcaactcactgcaagaagtcaagattctacacatattccacatttgaaaatgatttatccatctcagttatggactaataaatatgaaagtattatgcaaaaagtattctgtcacataaaaggttaattataaagg

SEQ ID NO: 145722 - DNA, 679 bp, Homo sapiens
  Payload ID: 8899
  Gene Symbol: KHDRBS3
  Gene Name: KH domain containing, RNA binding, signal transduction associated 3
  ENST ID: ENST00000517394
  CDS Start-End: 198-679
attggtggctggcttgaggttcggaatagtggtgaagggagtccttgccattttcacacgactccagccagctcagggtgtgaaagatcctaggaagtactgcgggtcagggatacagagatttctggaggcacgcctacccgggacagtgttcccctggctttttcctcctgtggcttcctgaatcatctgctggcatgcacgaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagg

SEQ ID NO: 145723 - DNA, 889 bp, Homo sapiens
  Payload ID: 8899
  Gene Symbol: KHDRBS3
  Gene Name: KH domain containing, RNA binding, signal transduction associated 3
  ENST ID: ENST00000524199
  CDS Start-End: 94-889
ggtcgtttgcacggggacctgggaggctgtgggacacctaggggaagaccctgatgtgaattttggggacttggaaggagaaggctggggcgcatggaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccc

SEQ ID NO: 145724 - DNA, 1134 bp, Homo sapiens
  Payload ID: 8900
  Gene Symbol: KHDC1
  Gene Name: KH homology domain containing 1
  Uniprot ID: Q4VXA5
  ENST ID: ENST00000257765
  CDS Start-End: 425-919
gcgcgcctcgcgcggccgcggcgcgagccgggacccctggaagggtcgggtgcgcggcccaggaggtaccgctgtctcctcacaatcggccaggcctgcagccgctgccgccgctgccgccgccgccgccgccgccgccgccgccctactcagggagtggcccaggcctgcggcgcgccaccctcacctccttcattcctaccgtcaaagcccagccttggctacctgacccccctgtggtctcgaactcggttagtccggtgaagggacagagaagcctgggttcccggcggcatcactgagatgctcagtcctgaattctgccctccattaggattatctgctttgtgggataatttcctcattggttgagtcagtgagttgcgtgtctgcaagagagcatcctatctggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgcaaa

SEQ ID NO: 145725 - DNA, 1430 bp, Homo sapiens
  Payload ID: 8900
  Gene Symbol: KHDC1
  Gene Name: KH homology domain containing 1
  Uniprot ID: Q4VXA5
  ENST ID: ENST00000370384
  CDS Start-End: 502-1215
ggcggaagaggcgggtccagggcggtgtaattaaggcgcggagcccagaccctcctgctacagtgcctcgggctttcctggaggcgggcggcgggatgctgctccgttctccgggtcctctcctccggttcttgtcgtttggtcacgccctcagttcagtcggttattggaaaacgatcaaggcccaaagatggtttacgtggcgttgtggatgttatcaccgttgtttggtgaccgagcctggagcttgagccctgggacgtcttgccagccgcatgtggtcccgtgcccacttctcgcggtggcgcgttaatccacctagactgtgcattggtccagtctgggttgaccccgacccgaagtggccctttccttcgcgtcctgaacttcgcttctccgtcggtgtctggtctcttcccgccggcgggctctgcggtggcgggaggagctgtactactcgtgccttagcgcacccttactttcccaggccagaaacgcgaaatgctgtcggccttccagaggctgttccgagtcttatttgtgattgaaacagtctcagaatacggagtcctgatcttcatttatggatggccctttctccagacccttgcgatgctcctgatcgggacagtgtctttccacctttggatccgcagaaatcgagagagaaactcaaggagcggaaagactagatgccgatccaaaaggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgcaaa

SEQ ID NO: 145726 - DNA, 547 bp, Homo sapiens
  Payload ID: 8900
  Gene Symbol: KHDC1
  Gene Name: KH homology domain containing 1
  ENST ID: ENST00000433730
  CDS Start-End: 253-547
cggccgcggcgcgagccgggacccctggaagggtcgggtgcgcggcccaggaggtaccgctgtctcctcacaatcggccaggcctgcagccgctgccgccgctgccgccgccgccgccgccgccgccgccgccctactcagggagtggcccaggcctgcggcgcgccaccctcacctccttcattcctaccgtcaaagcccagccttggctacctgacccccctgtggtctcgaactcggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgag

SEQ ID NO: 145727 - DNA, 1101 bp, Homo sapiens
  Payload ID: 8900
  Gene Symbol: KHDC1
  Gene Name: KH homology domain containing 1
  Uniprot ID: Q4VXA5
  ENST ID: ENST00000610435
  CDS Start-End: 395-889
gcgcgcctcgcgcggccgcggcgcgagccgggacccctggaagggtcgggtgcgcggcccaggaggtaccgctgtctcctcacaatcggccgccgccgccgccgccgccgccgccctactcagggagtggcccaggcctgcggcgcgccaccctcacctccttcattcctaccgtcaaagcccagccttggctacctgacccccctgtggtctcgaactcggttagtccggtgaagggacagagaagcctgggttcccggcggcatcactgagatgctcagtcctgaattctgccctccattaggattatctgctttgtgggataatttcctcattggttgagtcagtgagttgcgtgtctgcaagagagcatcctatctggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgc

SEQ ID NO: 145728 - DNA, 632 bp, Homo sapiens
  Payload ID: 8900
  Gene Symbol: KHDC1
  Gene Name: KH homology domain containing 1
  ENST ID: ENST00000610330
  CDS Start-End: 45-431
gttgcttggacttggccctattctgtatcaggtcggagcagagcatggacatgggaacgagtgctctcagcaagaagccgtggtggaccctgcctcaaaactttcatgcaccaatggtgtttcacatggaagaggaccaggaggagctcatcttcgggcatggtgacacataccttcgctgcattgaggtgcacagccacacccttattcagctggagagttggttcacagctacaggccagactcgtgtgactgtagtcggaccacacagggcaaggcagtggctgctgcacatgttttgttgtgtggggagccaggactcctatcatcatgctcgaggcctggagatgctggaacgtgtccgaagccagcctctgaccaacgatgacctggtcacctccattagtgtgccaccatacactggagactgatctcccctgggaagtggggatgagaggagaaatcttggcttcacttttggtgagaaagacatgatagacactgaggaaagtttgaacttgtggccgggacctgtccctctcaggtcttctagacatgtctgagggaagtctcttgaatgtaagaaagtgttattggcaaagcaatccaataaaataagctacctatgatgc

SEQ ID NO: 145729 - DNA, 635 bp, Homo sapiens
  Payload ID: 8901
  Gene Symbol: KHDC1L
  Gene Name: KH homology domain containing 1-like
  Uniprot ID: Q5JSQ8
  ENST ID: ENST00000370388
  CDS Start-End: 45-431
gtttgttagactttcccctattctgaatcaggtgggagcacagcatggccgtgggaacgagtgctctcagcaaggagccgtggtggaccctgcccgaaaactttcattctccaatggtgttccacatggaagaggaccaggaggagctcatcttcggacttgatgacacgtaccttcgctgcattgagctgcacagccacacccttattcagctggagaggtgtttcacagctacaggccagacacgtgtgactgtagtcggaccaccaatggcaaagcagtggctgctgctcatgttccattgcgtggggagccaggactccaagtgtcacgctcgaggtctgaagatgctagagcgtgtccgaagccagcccctgaccaatgatgacctggtcacctccgttagcctgccaccgtacaccggagactgatctcccctgggaagaggggatgagaggagaagtcttggcttcgcttttggtgagaaagacatgaaaaacactgaagaaagtttgaatttgtggccagacctgcccctctcaggccttctaggcatgtgtctgagggaagtctcctgagtgttagaagtgttattggcaaagcaatccaataaaataagctacctatgatgcaaa

SEQ ID NO: 145730 - DNA, 2993 bp, Homo sapiens
  Payload ID: 8902
  Gene Symbol: KHSRP
  Gene Name: KH-type splicing regulatory protein
  Uniprot ID: Q92945
  ENST ID: ENST00000398148
  CDS Start-End: 94-2229
tgtggagcgaggccttgttcccgcgttgagccgccgccgccgccgccgcctcctcagcttcagcctccgcgccaggcccggccccgccgcgccatgtcggactacagcacgggaggacccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcacccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctc

SEQ ID NO: 145731 - DNA, 672 bp, Homo sapiens
  Payload ID: 8902
  Gene Symbol: KHSRP
  Gene Name: KH-type splicing regulatory protein
  ENST ID: ENST00000595258
  CDS Start-End: 324-672
aacgggtgacccccctgcagggagtaggggcgcactgggggtcaccaggagcggcgcctgggtgtgcaggcgccccggagctcggagacgcacttttgggaccccccccttagccccccggccttaggacatgcctggagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcagg

SEQ ID NO: 145732 - DNA, 379 bp, Homo sapiens
  Payload ID: 8902
  Gene Symbol: KHSRP
  Gene Name: KH-type splicing regulatory protein
  ENST ID: ENST00000594745
  CDS Start-End: 1-344
gggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcacccccacagcaggactacacgaaggcttgggaggagtactacaagaagcaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattg

SEQ ID NO: 145733 - DNA, 801 bp, Homo sapiens
  Payload ID: 8902
  Gene Symbol: KHSRP
  Gene Name: KH-type splicing regulatory protein
  ENST ID: ENST00000595548
  CDS Start-End: 295-801
gggcggtaggcgggggcctggccctcccgctgcgcctcgagtgggatcccaacgggtgacccccctgcagggagtaggggcgcactgggggtcaccaggagcggcgcctggattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggac

SEQ ID NO: 145734 - DNA, 851 bp, Homo sapiens
  Payload ID: 8902
  Gene Symbol: KHSRP
  Gene Name: KH-type splicing regulatory protein
  ENST ID: ENST00000600480
  CDS Start-End: 1-530
ccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcacccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttcttt

SEQ ID NO: 145735 - DNA, 837 bp, Homo sapiens
  Payload ID: 8902
  Gene Symbol: KHSRP
  Gene Name: KH-type splicing regulatory protein
  ENST ID: ENST00000599395
  CDS Start-End: 1-837
cctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgaacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaag

SEQ ID NO: 145736 - DNA, 328 bp, Homo sapiens
  Payload ID: 8902
  Gene Symbol: KHSRP
  Gene Name: KH-type splicing regulatory protein
  ENST ID: ENST00000597656
  CDS Start-End: 1-239
cccagcagcccggagcacccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcagccttcctgaacctgcctctctgaggataaagcaattcattttctcccaccctcggccctcttgtttttaaaataaacttttaaaaaggaaaaaaaaaa

SEQ ID NO: 145737 - DNA, 999 bp, Homo sapiens
  Payload ID: 8902
  Gene Symbol: KHSRP
  Gene Name: KH-type splicing regulatory protein
  ENST ID: ENST00000594496
  CDS Start-End: 1-432
tactcacactactaccagcagcccccgggccccgtccccggccccgcaccggcccctgcggccccaccggctcagggccagcagccccagcagcccggagcacccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcctggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctct

SEQ ID NO: 145738 - DNA, 956 bp, Homo sapiens
  Payload ID: 8902
  Gene Symbol: KHSRP
  Gene Name: KH-type splicing regulatory protein
  ENST ID: ENST00000595223
  CDS Start-End: 1-809
gcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggccagcagccccagcagcccggagcacccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtggggggg

SEQ ID NO: 145739 - DNA, 2226 bp, Homo sapiens
  Payload ID: 8902
  Gene Symbol: KHSRP
  Gene Name: KH-type splicing regulatory protein
  ENST ID: ENST00000619396
  CDS Start-End: 75-2210
cccgcgttgagccgccgccgccgccgccgcctcctcagcttcagcctccgcgccaggcccggccccgccgcgccatgtcggactacagcacgggaggacccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcacccccacagcaggactacacgaaggcttgggaggagtactacaagaagcaagcgcaagtggccaccggagggggtccaggagctcccccaggctcccaggaccccttcccccagcagccaagccccctcctccctcccgccctggctcagctcccgcggccccgcccgtcccccctcccaggactggtctgttgtcttttcatctgttcaagaggagattgaaactgaaaacaaaatg

SEQ ID NO: 145740 - DNA, 4564 bp, Homo sapiens
  Payload ID: 8903
  Gene Symbol: KIAA0040
  Gene Name: KIAA0040
  ENST ID: ENST00000423313
  CDS Start-End: 538-837
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 145741 - DNA, 4494 bp, Homo sapiens
  Payload ID: 8903
  Gene Symbol: KIAA0040
  Gene Name: KIAA0040
  ENST ID: ENST00000444639
  CDS Start-End: 468-767
tggagcgaaacctcaactatgccaggcgtcggcccgtaggaaggcagggaacacagagggcgctgccctcggcggcagcggcagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 145742 - DNA, 2485 bp, Homo sapiens
  Payload ID: 8903
  Gene Symbol: KIAA0040
  Gene Name: KIAA0040
  ENST ID: ENST00000545251
  CDS Start-End: 425-724
gcagaggcaaccaaaaaggaacccacacctccctccagggcccggggcgctgtcagacggggcagcaaccaggagattccctgggcctgcaggaagcccttccgcggaccgaaagactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattcta

SEQ ID NO: 145743 - DNA, 4340 bp, Homo sapiens
  Payload ID: 8903
  Gene Symbol: KIAA0040
  Gene Name: KIAA0040
  Uniprot ID: Q15053
  ENST ID: ENST00000619513
  CDS Start-End: 697-1158
ctagactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 145744 - DNA, 7407 bp, Homo sapiens
  Payload ID: 8904
  Gene Symbol: KIAA0100
  Gene Name: KIAA0100
  Uniprot ID: Q14667
  ENST ID: ENST00000528896
  CDS Start-End: 76-6783
cggtgctgcgcggatccggcgtcggggcccggcatggcgggggccggggccaagccgggccggacccggacctaaatgcctctgttcttctccgcgctgttggtcttgctgctagttgcgcttagcgccctctttctaggccggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctca

SEQ ID NO: 145745 - DNA, 6856 bp, Homo sapiens
  Payload ID: 8904
  Gene Symbol: KIAA0100
  Gene Name: KIAA0100
  ENST ID: ENST00000544884
  CDS Start-End: 392-6670
atgagtcagccaggtccaccgccagcccaggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctca

SEQ ID NO: 145746 - DNA, 1271 bp, Homo sapiens
  Payload ID: 8904
  Gene Symbol: KIAA0100
  Gene Name: KIAA0100
  ENST ID: ENST00000583403
  CDS Start-End: 93-353
agctggtcggcccgcggcggtgctgcgcggatccggcgtcggggcccggcatggcgggggccggggccaagccgggccggacccggacctaaatgcctctgttcttctccgcgctgttggtcttgctgctagttgcgcttagcgccctctttctaggccggtggcttgtggtccggttggccaccaagtggtgtcagcggaagctgcaggcggagctaaagattggctccttccgctttttttggatccagaatgtcagtcttaagtttcagcaacaccagcaaacagtgacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaaggttcatgggtcggggtactggtactgagcgagaatgggaggactagatactctctttgctcatgccccatatggtctccttaatctaatctcagtgtaactggggagtggaaggagggaacatactgagagaaaatagccccagctcacaagttttgatgacagtctgttgatccctttgccggcttctgaccctctcccagttttacctcttg

SEQ ID NO: 145747 - DNA, 449 bp, Homo sapiens
  Payload ID: 8904
  Gene Symbol: KIAA0100
  Gene Name: KIAA0100
  ENST ID: ENST00000581267
  CDS Start-End: 1-65
gccagggcccaagcctagcatctaagcctgttccctgttcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaag

SEQ ID NO: 145748 - DNA, 6852 bp, Homo sapiens
  Payload ID: 8904
  Gene Symbol: KIAA0100
  Gene Name: KIAA0100
  ENST ID: ENST00000389003
  CDS Start-End: 392-6670
atgagtcagccaggtccaccgccagcccaggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggcaatactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgt

SEQ ID NO: 145749 - DNA, 862 bp, Homo sapiens
  Payload ID: 8904
  Gene Symbol: KIAA0100
  Gene Name: KIAA0100
  ENST ID: ENST00000577261
  CDS Start-End: 1-862
gaccccagcccacctttgccctggtgggacaagagccgtcttctgttccatggagactggcacatggacattgaacaggcgaacctgcaccagctggccactgagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctg

SEQ ID NO: 145750 - DNA, 2194 bp, Homo sapiens
  Payload ID: 8905
  Gene Symbol: KIAA0101
  Gene Name: KIAA0101
  Uniprot ID: Q15004
  ENST ID: ENST00000300035
  CDS Start-End: 140-475
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccgggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaaaaaaaaaaaaaaaattttaaaaaaggctgagtgcagtggctcacacctgtaatcccagcactttgggaggccaaggcaggtggatcacctgagataggagttcaagaccagcctggccagcatggtgaaactgtcactactaaaaatgaaaaaatgagccaggcatggtggcacatgcctgtaatcccagctactcaggaggctgaggcaggagaatcgcttgaacctgggaggtggaggttgcagtgagcccagattgtgccactgcactccagcctgaacaacagagtgagacaatgtcttaaaaaaaaaaaaagaaagaaaagaaaaaaatatatatttatatatgaacaataaaaaattagcctggcatggtggcacacacagtggaaccagatcccatctcttaaaagaaattttcctaggatttgcatttgattcgctatcataaaatataattttaaagttggaagtcaatataacatgaaaggcaaatcatgccataaacccataggcatggcaaaactcctaagagctactatgacatttttcaacataaccagaggtataattgaagaagtgggtataatattcctcatcaccctttttgcagcagcctgttgtcaaaagtaatcatattttagtaggcatatttttctgaaatacgtttgtaataaatgcatacttatttttacaa

SEQ ID NO: 145751 - DNA, 911 bp, Homo sapiens
  Payload ID: 8905
  Gene Symbol: KIAA0101
  Gene Name: KIAA0101
  Uniprot ID: Q15004
  ENST ID: ENST00000380258
  CDS Start-End: 74-271
ggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttg

SEQ ID NO: 145752 - DNA, 749 bp, Homo sapiens
  Payload ID: 8905
  Gene Symbol: KIAA0101
  Gene Name: KIAA0101
  ENST ID: ENST00000559519
  CDS Start-End: 71-325
ccttgtccagtgaaacaccctcggctgggaagtcagttcgttctctcctctcctctcttcttgtttgaacatggtgcggactaaagcagacagtgttccaggcacttacagaaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaa

SEQ ID NO: 145753 - DNA, 766 bp, Homo sapiens
  Payload ID: 8905
  Gene Symbol: KIAA0101
  Gene Name: KIAA0101
  ENST ID: ENST00000558008
  CDS Start-End: 68-415
tgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaccaggagccacccatcctccagcacactgagcagcaagctggacacacggcacactgatccaaatggagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgtt

SEQ ID NO: 145754 - DNA, 487 bp, Homo sapiens
  Payload ID: 8905
  Gene Symbol: KIAA0101
  Gene Name: KIAA0101
  ENST ID: ENST00000625619
  CDS Start-End: 140-487
ggctcgggagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaccaggagccacccatcctccagcacactgagcagcaagctggacacacggcacactga

SEQ ID NO: 145755 - DNA, 2203 bp, Homo sapiens
  Payload ID: 8906
  Gene Symbol: KIAA0141
  Gene Name: KIAA0141
  Uniprot ID: Q14154
  ENST ID: ENST00000194118
  CDS Start-End: 88-1635
ggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctag

SEQ ID NO: 145756 - DNA, 4970 bp, Homo sapiens
  Payload ID: 8906
  Gene Symbol: KIAA0141
  Gene Name: KIAA0141
  Uniprot ID: Q14154
  ENST ID: ENST00000432126
  CDS Start-End: 135-1682
cccttctaattggccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctcatcactcttgcccttgagtattatgggaagagccagggagacgggcagggggagctgaaagctgaggctccgtcctcatctctaaactctccactaaccaatttaaaggatcttaaaagcttctccaggagagagacttaggaaaaaaaaagatttctgagtcagtgctaatgagtccagttactgaatttgtgaatagctattccctggcttctggatgttagcccaagttgaatagcatagatgtggttgagagtggggtctgggagggatagagagcccaccgcccaccccccacaatcccatgactgagtggagaccaaccagcctggccaattcaaaggcaagaagatttgaggggggaaagttgtccacgtttccctctctgcttcccaccccatctctctcaacttcttagtggtcctgccatactttcctagcacctctctttcacccggggagcccaagcgtcctctagctccatctcctcgcctgctccctgcctccttttcagggctgccctgcacactggctcaccactgttggaccctgcacatggccaccttccacagatggcactccttgggagcagggtccttgtctttgtattccagtgtccccagcactgagtgcaaggccccatgcagggtaggaaacctgaggtttcaagctcagggttttaagctgtgcagtgcactaagctctctgccaaaaaacaaacaaaaaaaggtttctgtggttaaataagtttgggaaatgctgcaccagacgtcccctttttatagattcacaatacacatcagcatatttgaggttccaagaagtcctccagtaaagaacttggttaacccaatgttttctctcactgaattgagcccagagcccgtttccctacagattgcttttgagccttcctggggcaccctctgcgtgaaatgtcaccgtgtgccctccctgtggagccccactccccagcctcctcccctctgtggtcattttggattttctgactacttccttctagccatagctggggccgagggctggttcacagtctggccactgggcgtcctgtggtgaaggccagatgcagccctccctgagtggctctccctcccactcagtcactactgagctaagtactgattcaatttggggtgccaaaggttgggggtaggatatttttaagctctccaatttaaaaaggaagggcctctcctgtggaaagggaaggatggcagagtcgtgagaaaggtgttgtcaagggaccaaaaatccttggctgttcagtcactgcggtcttgatccagccccagggggatgggcttcactggcagagctgggtactgctgtgcttttgccattaaaattctgttattaatgactcatcatcagtgccccagaggaagtgtgagaggacgagagggaggtggctcccatcagcagggccagcctgggtcaggatgctgggttaaagcccggcgccctcaccaatgagacctttgtgggaagctctactgcctcagtttccctatccggagatgctgttttcagggagtcctgacactatgatgggaacaaggctatttggtttactatatcattagtgctaatatagtgtggggcactcagatgttcagtaaatatacattcaacaaataagtgagtgattatactcaactccccccacccaatgcccagcaccaagcctacccagcacatagtaggtactttaagtaatttgaatgaataattttaaataacttgaatgaataattctgtattgccccccactcgccgcctatacacacgcacacacgcacacacacacacacggtttcctgtgctacttctggcacttagtaattattcaataaacacaaaatgtttgttgca

SEQ ID NO: 145757 - DNA, 998 bp, Homo sapiens
  Payload ID: 8906
  Gene Symbol: KIAA0141
  Gene Name: KIAA0141
  ENST ID: ENST00000508751
  CDS Start-End: 33-998
ggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaagttggctgccagccagggccacagcctggctcagtaccgctatgccaggtgcctactacgagacccagcc

SEQ ID NO: 145758 - DNA, 1342 bp, Homo sapiens
  Payload ID: 8906
  Gene Symbol: KIAA0141
  Gene Name: KIAA0141
  ENST ID: ENST00000507481
  CDS Start-End: 1-651
gcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaagaaattccagcgggagttcaggttcccaagcaatttcacgtacatggctggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggatt

SEQ ID NO: 145759 - DNA, 4187 bp, Homo sapiens
  Payload ID: 8907
  Gene Symbol: KIAA0196
  Gene Name: KIAA0196
  Uniprot ID: Q12768
  ENST ID: ENST00000318410
  CDS Start-End: 351-3830
agccgtcgccggcgagtggtcacatgatgcccctccctgctcccagccgcttcggtcatgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaa

SEQ ID NO: 145760 - DNA, 859 bp, Homo sapiens
  Payload ID: 8907
  Gene Symbol: KIAA0196
  Gene Name: KIAA0196
  ENST ID: ENST00000523297
  CDS Start-End: 369-859
actgcggatagaagaggaccgccgccttgagggaggggtggaaactgggtgccggctccgcgcgcgacctccggccctgcgcgtgcgccgtggcgcggcccggctgacagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaac

SEQ ID NO: 145761 - DNA, 3667 bp, Homo sapiens
  Payload ID: 8907
  Gene Symbol: KIAA0196
  Gene Name: KIAA0196
  ENST ID: ENST00000517845
  CDS Start-End: 282-3317
atgtgaccgcctggggagtcaggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagt

SEQ ID NO: 145762 - DNA, 3322 bp, Homo sapiens
  Payload ID: 8908
  Gene Symbol: KIAA0226L
  Gene Name: KIAA0226-like
  ENST ID: ENST00000378781
  CDS Start-End: 420-1937
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaac

SEQ ID NO: 145763 - DNA, 2361 bp, Homo sapiens
  Payload ID: 8908
  Gene Symbol: KIAA0226L
  Gene Name: KIAA0226-like
  Uniprot ID: Q9H714
  ENST ID: ENST00000378784
  CDS Start-End: 153-1940
ggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 145764 - DNA, 2731 bp, Homo sapiens
  Payload ID: 8908
  Gene Symbol: KIAA0226L
  Gene Name: KIAA0226-like
  Uniprot ID: Q9H714
  ENST ID: ENST00000378787
  CDS Start-End: 476-2383
accggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 145765 - DNA, 3206 bp, Homo sapiens
  Payload ID: 8908
  Gene Symbol: KIAA0226L
  Gene Name: KIAA0226-like
  ENST ID: ENST00000378797
  CDS Start-End: 478-1821
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctgggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaac

SEQ ID NO: 145766 - DNA, 3956 bp, Homo sapiens
  Payload ID: 8908
  Gene Symbol: KIAA0226L
  Gene Name: KIAA0226-like
  Uniprot ID: Q9H714
  ENST ID: ENST00000389908
  CDS Start-End: 584-2572
agctgacacagtgagttgtccctgacactcatgactttcaagccctgtgtcttggagggcactgtgatctggaagttcaccttccccatgaaaaaacccaaaccagcctctccttttcctgcatggtgatccgtctgtaatgatcagtgacattctcagaattaaccaatcaggaaattcttggaaagtccacgcctcagcatttagtgcttgggaaattctacttccagatcccagaggggacagagcagatttccagttctcctagcaccaccatgatctcaggactaaccactgcacacccgtgatgggattccaaaccttcgctgcaagaggacaaggtgacgagttgctgacagtgaaggctaaactaacgcggacagtgaagtgctacatgagtcggactcagactccaggtgaagcagccagcagaggtcagagagagacagctcacgttccggaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaa

SEQ ID NO: 145767 - DNA, 2997 bp, Homo sapiens
  Payload ID: 8908
  Gene Symbol: KIAA0226L
  Gene Name: KIAA0226-like
  ENST ID: ENST00000409879
  CDS Start-End: 1062-2579
actccttcggcgttggctcttgcgccggggtcgttgtttcgtgacaaccactcaggtagccgtttctgagacggcagatgcggccgctttagccctgagcgggctccgcggctccctggacggtctctgccagtgcccgactcttctcttccggactccacgccaagcagcgaccctgagccaacagccagagcgcccagaaatggcggcctggactgcctcgcactggccagtcaaggggatcctgaagaacaagacctctacagcttcctctatggtggcctcggctgaacagcccagcgggagtgtcgaggaggagctgagcaaaaaatcccagaagtgggaagaaatgaacatcctggcgacatatcatccagcggacaaagactatggtttaatgaaaatagttgaaccaagcactccttcctgtcgtaagatgggtgatggtgaagatgcgtgtagtggtatagaaaccactgaagccgtggcaccagatatcttagctaagaaattagctgttgctgaaggcttgaacccaaagtatcgggttcaggaacaagaaagcagtggagaggaggctagtgacctctcacctgaagaacgagaaaaaaggcgacaatttcaaatgaaaaggaagcttcactacaatgagggactcaatatcaaactagctagagaattaatttgaaaagacctacatgatgacaaagatgaagaaatgttaaagactgcaggtggagaaagcatgaagacggaagaatcaaatcaaagctctacaacaagtgaccaacggcaaaacacattcagttctcctagcaccaccatgatctcaggactaaccactgcacacccgtgatgggattccaaaccttcgctgcaagaggacaaggtgacgagttgctgacagtgaaggctaaactaacgcggacagtgaagtgctacatgagtcggactcagactccaggtgaagcagccagcagaggtcagagagagacagctcacgttccggataaaataaaaaatggggatattgacctcctgtcactactgcatggactttgatggtttccaatcattactttctcctctgtgtcaatctgcctcttcgagaaattcatactcctggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgacccc

SEQ ID NO: 145768 - DNA, 3979 bp, Homo sapiens
  Payload ID: 8908
  Gene Symbol: KIAA0226L
  Gene Name: KIAA0226-like
  Uniprot ID: Q9H714
  ENST ID: ENST00000429979
  CDS Start-End: 606-2594
ggatttctaggaggaccggcagaggcgcgcataggtgcgtggtgctgggcccgggcgccgcggcaccggtgtaggagcgcgcatctccagagtttcttccatctgggcgacgtctcggtgcctgcggcgggaacggcgctttgcttccctgaggagcttctagagagctacggtggcccccgtgtgggaggcggggggcgtggcggcgtcggggcgtcgctgtcccctcctcggtagctctcctccctcccctttctgctgttaccgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaatctgtttgctctggcttttatttcttcaggaagcagacttccacttaaatgccattttgtgattgtgtcaatcatacacattttatttacttcagagtttgaatagagagtacacatttcttctgcagatttatttcatgatgagtttgagttgcttagcagggcgtgtgggtcccgttgaagtgcagtttgaagcaactgcttctagatggcactctttcaggtggcacaaattgaacctgtatttgtcatctctgttccacacactgcaatgtcaagggatgcagaagtgagtagaattccatccctgcccttgaggatcttgctttaacagatgtaaaactgaacataaggtatttgcagatttaaacgaactgggggaaataatgaacagtgtgattctagtaataacattaaaatcatagacattgactaataaggttaaatgaatcacaaaacctttatgaatttcttttttctaatagttcttatatgttttcctgaaacatgtgagcctattcttttttcttctactttctatatactttctcccacttgagaaaggggccttgaggctgggtcccttcatggtatacctttagactgaacggtttgcaacctagggcttgggcattacattccctgggattcacatgccctaactaaacctaccttgattttctcagacagcacaggcaggcaataaagcgtcacagattgtcccctaaccccatccagccatgtgtatgagtgtgttttattcaatgggatagtactgagcacatgaaagaaatgaatgacttctgtcaatctcttttcattcagtcttctcattctgtcaattgttttctcatccgcagtgcctctgccagaactgtgctcacatccattatttaagccagatcttttctaagtattatagaagtgtagaggcacatagaataaataaaaccagacttcaaac

SEQ ID NO: 145769 - DNA, 494 bp, Homo sapiens
  Payload ID: 8908
  Gene Symbol: KIAA0226L
  Gene Name: KIAA0226-like
  ENST ID: ENST00000417405
  CDS Start-End: 106-494
gcgcggtggccacggaacgctgcccggagccgcgcgagggaggacccgacgcgcggcgtttacccagcgcagcgttccaccgctcgggtttggctggaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgg

SEQ ID NO: 145770 - DNA, 2754 bp, Homo sapiens
  Payload ID: 8908
  Gene Symbol: KIAA0226L
  Gene Name: KIAA0226-like
  ENST ID: ENST00000441284
  CDS Start-End: 341-1204
cgggagcgcggtggccacggaacgctgcccggagccgcgcgagggaggacccgacgcgcggcgtttacccagcgcagcgttccaccgctcgggtttggctggataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggcaagttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaaggaaaaagatggtctatattctctttattgcatatacttaatgtttcaaaagaatgcagattctgtgtttaagcacagggctgatagttgtggttttgtttacaaatgttctgttttggctgctattggttttttaaagaggttttttatacttttgtatttgaatagttatgtttcactgatgctgagccagtttgtatgtgtgtgcatatatgtgaactgtaactgacaagatgaattactcagtttctctttctctaaagcttgtttgatgaaactggttggtcctttcagtgaacaaaaatatgaccccaaa

SEQ ID NO: 145771 - DNA, 972 bp, Homo sapiens
  Payload ID: 8908
  Gene Symbol: KIAA0226L
  Gene Name: KIAA0226-like
  ENST ID: ENST00000439642
  CDS Start-End: 438-972
ttaatactgtgtctctggtggctctagtgatgcaatcattctcgatggggccactgactctgatgtcacaatgacttggctggaggtgtcctgaagtctcttgtttgtccagggcctttgctgcagcttatatgttcactagtaatctggcctgtgcctaccttttaatcccagctggaaaatctcagtaagaatgatgataaaataaaaaatggggatattgacctcctgtcactactgcatggactttgatggtttccaatcattactttctcctctgtgtcaatctgcctcttcgagaaattcatactcctgaatagctctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaag

SEQ ID NO: 145772 - DNA, 1948 bp, Homo sapiens
  Payload ID: 8908
  Gene Symbol: KIAA0226L
  Gene Name: KIAA0226-like
  Uniprot ID: Q9H714
  ENST ID: ENST00000631139
  CDS Start-End: 260-1843
cccctttctgctgttaccgggagcgcggtggccacggaacgctgcccggagccgcgcgagggaggacccgacgcgcggcgtttacccagcgcagcgttccaccgctcgggtttggctgggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaagagggaccttgtggtggcagcccagaattttttctgtgccggctgtggaactccagtagagcctaagtttgtgaagcggctccggtactgcgaatacctagggaagtatttctgtgactgctgccactcatatgcagagtcgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagttcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataacaccgatttgtgtctattattggtgacattgttttagatattgggtattgtatattaa

SEQ ID NO: 145773 - DNA, 7841 bp, Homo sapiens
  Payload ID: 8909
  Gene Symbol: KIAA0232
  Gene Name: KIAA0232
  Uniprot ID: Q92628
  ENST ID: ENST00000307659
  CDS Start-End: 456-4643
cgcaggccagggccgcccggcgctcggcagccgcccgcagcccctcggagccagaggagaggcgcccccgccggccgccgcgccgcccggcagcctcggcaggtagtgtacactgataaaggtagggcgcggtggactctgcccctgtaaccgttccggagaatgcgttgagaatgaagacaaccagttctgccggagacttccatttggcctcaatgtgaaattaaagtagaaaatcacatctacatgcatgttgctatcaggatgttgattcattagtcatgcctgaagagggaaagtctgttttaggtggctgactaccagcaaaaataaatgcttatcctacatgtcaagcatctctactttttactggagtgaaaatcccctccagataccaacagaatatcaactgcagaaaatgcttcacattttaaggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacaggagaatgacatcttcctgggctgggaaaaaggagcttataagaaatggggaaagagtaagaaaaaatgttcagatctaactctagaagaaatgaaaaaacaggctgctgtccagtgtcttcgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttacagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacattttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaacagtttgttgtttttatttctcatagcaaagcttcttttgtaaagaactccagcttccttttactcatgagcatccgtggaagagcaagtgcccaggttacatttgttctagatggaggtcatttagctctcattgcagacactgctgaaaacattgtgcagctttgctagggaagaaagtggtgtggcctgctgagaaatcagcggctcctccccatctcacccccagcacacgcagggactactacctgagtctgcaaaacacatagcatttttgtccgtggatggtacacaaagctcaatctttttgttttcttctggggaaaaaattaaatctttatatgttaatatgattgatattcattgtgcaaaaaaaatcagtgtgtttttaaagaagtataagggaaaaggaaaactcatatgtccttctgtcactctgagacatacactggtaacatctgtgcaagcccctttccaggattctgaatgtacagtatatatgaatgcatacacagagaaatttacattcaagagtgtactatacttgttcttctataacatcagaaataggtttttactcagatgtcttcatgtcggtaattatagaactacataattatttttatagctgtattatgtagatttaacaggttcctcattgataaaacaatgtttttttggttgtttattcagtatctgaataacgtttctatggacatctgtaaacatgtatgaggggacttttaaaagttcatggaaaatggaattaaaagaaaaataaaaaaatataaacttta

SEQ ID NO: 145774 - DNA, 7771 bp, Homo sapiens
  Payload ID: 8909
  Gene Symbol: KIAA0232
  Gene Name: KIAA0232
  Uniprot ID: Q92628
  ENST ID: ENST00000425103
  CDS Start-End: 380-4567
acgtaaggcgcaggccagggccgcccggcgctcggcagccgcccgcagcccctcggagccagaggagaggcgcccccgccggccgccgcgccgcccggcagcctcggcaggttctgccggagacttccatttggcctcaatgtgaaattaaagtagaaaatcacatctacatgcatgttgctatcaggatgttgattcattagtcatgcctgaagagggaaagtctgttttaggtggctgactaccagcaaaaataaatgcttatcctacatgtcaagcatctctactttttactggagtgaaaatcccctccagataccaacagaatatcaactgcagaaaatgcttcacattttaaggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacaggagaatgacatcttcctgggctgggaaaaaggagcttataagaaatggggaaagagtaagaaaaaatgttcagatctaactctagaagaaatgaaaaaacaggctgctgtccagtgtcttcgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttacagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacattttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaacagtttgttgtttttatttctcatagcaaagcttcttttgtaaagaactccagcttccttttactcatgagcatccgtggaagagcaagtgcccaggttacatttgttctagatggaggtcatttagctctcattgcagacactgctgaaaacattgtgcagctttgctagggaagaaagtggtgtggcctgctgagaaatcagcggctcctccccatctcacccccagcacacgcagggactactacctgagtctgcaaaacacatagcatttttgtccgtggatggtacacaaagctcaatctttttgttttcttctggggaaaaaattaaatctttatatgttaatatgattgatattcattgtgcaaaaaaaatcagtgtgtttttaaagaagtataagggaaaaggaaaactcatatgtccttctgtcactctgagacatacactggtaacatctgtgcaagcccctttccaggattctgaatgtacagtatatatgaatgcatacacagagaaatttacattcaagagtgtactatacttgttcttctataacatcagaaataggtttttactcagatgtcttcatgtcggtaattatagaactacataattatttttatagctgtattatgtagatttaacaggttcctcattgataaaacaatgtttttttggttgtttattcagtatctgaataacgtttctatggacatctgtaaacatgtatgaggggacttttaaaagttcatggaaaatggaattaaaagaaaaataaaaaaatataaactttatttctc

SEQ ID NO: 145775 - DNA, 700 bp, Homo sapiens
  Payload ID: 8909
  Gene Symbol: KIAA0232
  Gene Name: KIAA0232
  ENST ID: ENST00000508423
  CDS Start-End: 470-696
ggccagttgccgggtaacggagcggagcggctcccggcgcgccgcctcccgccctccgcggagtggcgctggggccgccgccgccgctttacgtaaggcgcaggccagggccgcccggcgctcggcagccgcccgcagcccctcggagccagaggagaggcgcccccgccggccgccgcgccgcccggcagcctcggcaggttctgccggagacttccatttggcctcaatgtgaaattaaagtagaaaatcacatctacatgcatgttgctatcaggatgttgattcattagtcatgcctgaagagggaaagtctgttttaggtggctgactaccagcaaaaataaatgcttatcctacatgtcaagcatctctactttttactggagtgaaaatcccctccagataccaacagaatatcaactgcagaaaatgcttcacattttaaggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacag

SEQ ID NO: 145776 - DNA, 6802 bp, Homo sapiens
  Payload ID: 8910
  Gene Symbol: KIAA0319
  Gene Name: KIAA0319
  Uniprot ID: Q5VV43
  ENST ID: ENST00000378214
  CDS Start-End: 526-3744
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacata

SEQ ID NO: 145777 - DNA, 6620 bp, Homo sapiens
  Payload ID: 8910
  Gene Symbol: KIAA0319
  Gene Name: KIAA0319
  Uniprot ID: Q5VV43
  ENST ID: ENST00000430948
  CDS Start-End: 476-3559
agtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacaggtacggtatctacttcccagagcgcctggccgagaaataggaaagagggcagccagtaggcaggccaatacccaacaaaagtagaatcgagacgccctgagttcagaaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 145778 - DNA, 5314 bp, Homo sapiens
  Payload ID: 8910
  Gene Symbol: KIAA0319
  Gene Name: KIAA0319
  Uniprot ID: Q5VV43
  ENST ID: ENST00000543707
  CDS Start-End: 353-3571
agcctgtcttgggcttggtccagattcgctcctctggggctacgtcccggggaagaggaagcgaggattttgctggggtggggctgtacctcttaacagcaggtgcgcgcgcgagggtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaa

SEQ ID NO: 145779 - DNA, 6622 bp, Homo sapiens
  Payload ID: 8910
  Gene Symbol: KIAA0319
  Gene Name: KIAA0319
  Uniprot ID: Q5VV43
  ENST ID: ENST00000537886
  CDS Start-End: 526-3561
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 145780 - DNA, 6896 bp, Homo sapiens
  Payload ID: 8910
  Gene Symbol: KIAA0319
  Gene Name: KIAA0319
  Uniprot ID: Q5VV43
  ENST ID: ENST00000535378
  CDS Start-End: 644-3835
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcagtttgcttatggtggatgcactcatggcaaaaaaatcactggtgagcatcatttaagaagacccatgactagactgggctggccgagcccatgttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 145781 - DNA, 5315 bp, Homo sapiens
  Payload ID: 8910
  Gene Symbol: KIAA0319
  Gene Name: KIAA0319
  ENST ID: ENST00000616673
  CDS Start-End: 803-2254
agatactgtggcattgacaatcacggctctcaggttctcaggatgcctcacactagctgctcaaaaaaatttattcaaaatgctctttcttctacttgtccagtgctctaccattcagtaagcatttgacctgggacctgtggcctgtcaaatgcattgtttttaagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 145782 - DNA, 4789 bp, Homo sapiens
  Payload ID: 8911
  Gene Symbol: KIAA0319L
  Gene Name: KIAA0319-like
  Uniprot ID: Q8IZA0
  ENST ID: ENST00000325722
  CDS Start-End: 236-3385
aggaggcggtgtttccggccgccgtcgctgtccagggaggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgca

SEQ ID NO: 145783 - DNA, 2377 bp, Homo sapiens
  Payload ID: 8911
  Gene Symbol: KIAA0319L
  Gene Name: KIAA0319-like
  ENST ID: ENST00000373266
  CDS Start-End: 128-1588
tgctgtgtcagagagggttgtttccttgaagggggaaacccttagcaaggtgcctcatgatatctgactccatattcactcacatgctgaactgggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtc

SEQ ID NO: 145784 - DNA, 912 bp, Homo sapiens
  Payload ID: 8911
  Gene Symbol: KIAA0319L
  Gene Name: KIAA0319-like
  ENST ID: ENST00000431916
  CDS Start-End: 1-912
agatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacacttt

SEQ ID NO: 145785 - DNA, 3213 bp, Homo sapiens
  Payload ID: 8911
  Gene Symbol: KIAA0319L
  Gene Name: KIAA0319-like
  ENST ID: ENST00000426982
  CDS Start-End: 135-3213
gggtattgcccgagtctgggggctggggctcgagcgaaggaggcaaggtgcagactgcctctggagagcgggcggcgagaggctgggggcccagattccttcgctttgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatg

SEQ ID NO: 145786 - DNA, 2171 bp, Homo sapiens
  Payload ID: 8911
  Gene Symbol: KIAA0319L
  Gene Name: KIAA0319-like
  ENST ID: ENST00000440579
  CDS Start-End: 117-2171
atttgcattcagaaatttaaaaaatactgggccagacataaccctcaggttactttacctctgagggtgcaacctcttctcctcaaaatgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtc

SEQ ID NO: 145787 - DNA, 872 bp, Homo sapiens
  Payload ID: 8911
  Gene Symbol: KIAA0319L
  Gene Name: KIAA0319-like
  ENST ID: ENST00000470388
  CDS Start-End: 198-431
ggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagcc

SEQ ID NO: 145788 - DNA, 889 bp, Homo sapiens
  Payload ID: 8911
  Gene Symbol: KIAA0319L
  Gene Name: KIAA0319-like
  ENST ID: ENST00000469892
  CDS Start-End: 71-889
gtttccggccgccgtcgctgtccagggaggctgaggcgagagtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacc

SEQ ID NO: 145789 - DNA, 766 bp, Homo sapiens
  Payload ID: 8911
  Gene Symbol: KIAA0319L
  Gene Name: KIAA0319-like
  ENST ID: ENST00000494948
  CDS Start-End: 228-766
atttgcattcagaaatttaaaaaatactgggccagacataaccctcaggttactttacctctgagggtgcaacctcttctcctcaaaagtaagaaagtgtgtttggtcaaagtcacaaagctgttagtagcagaactgcaactaaaactcagagatcttcttgtctgcgggctggtactctttccattctaccacatagtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagca

SEQ ID NO: 145790 - DNA, 1489 bp, Homo sapiens
  Payload ID: 8911
  Gene Symbol: KIAA0319L
  Gene Name: KIAA0319-like
  ENST ID: ENST00000478463
  CDS Start-End: 387-1421
gtgtttccggccgccgtcgctgtccagggaggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccggtaggtggccgggggcggctggctgccaggccgaggaccatgggctcaggggaggggcaagcgggacgggcgatgtcagcggctgcgctggccggatgttgggtccggaggtggcgcccctggctcggccagggcagccagctgcttctgtccttgcagtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaagctcactccaggcctgtatgaattcaaagtgattgtagagggtcaaaatgcccatggggaaggctatgtgaacgtgacagtcaagccag

SEQ ID NO: 145791 - DNA, 1524 bp, Homo sapiens
  Payload ID: 8911
  Gene Symbol: KIAA0319L
  Gene Name: KIAA0319-like
  ENST ID: ENST00000482929
  CDS Start-End: 269-1303
gatcagcgccggctcggagaggccccggctgggatgcaggggagggcccgaagggggctgagctcaccaggctgcggccccgagcggcgaagtcttctcccagcgcgatgctccgggagcctcgggccgctgctcacgccgcgttgcccactcctggctccaggctgctgcagctccacccccacccccgcaccgctcttgacgaatccgcggctgcttcactccgggctctggccaatgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtccactgatgatgataaaatcgttcagtaccattgggaagaacttaaggggcctctaagaga

SEQ ID NO: 145792 - DNA, 6717 bp, Homo sapiens
  Payload ID: 8912
  Gene Symbol: KIAA0355
  Gene Name: KIAA0355
  Uniprot ID: O15063
  ENST ID: ENST00000299505
  CDS Start-End: 874-4086
ggggccggaccggagacgtaacttccggtgtacacagccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgtgccagaaaaaaagaacagcggcagtggcggcggcttatctggcatgggccacacacctgaagtagaggaagctgtgcggtcctggcggggggctgctgaggcgacatctagactaagagaaagaggctgtgatggttgcctggcaggaattgaagttcaacaactcttttgttctcaaagtgcagcaattcctgagcaccagctaaaagaactgaacataaaaatcgacagtgctttgcaagcatataagatagctctggaaagcttaggacactgtgaatatgcaatgaaagccggcttccacctgaatccaaaggcgattgaagcaagtttgcagggctgctgcagcgaggcggaagcccagcagacggggcggaggcagacacccccgcagcccatgcagtgtgagctccccaccgtccctgtgcagataggatcgcacttcctgaagggcgtctcctttaatgagtcggccgccgacaatctgaaacttaagacgcatacaatgttacagctgatgaaggaggcaggctgctataatggaatcacatccagggatgattttcctgtgactgaagtgctgaaccaggtttgcccttccacatggcgaggtgcctgcaagacggcggtgcagctgctgtttggccaggctggactggtggtggttgacacagcacagattgagaataaagaagcctatgccccccagatcagtttagaaggctctagaatcgtggttcaagtcccatccacatggtgcctgaaagaagaccctgctaccatgtccctgctgcagagaagccttgatcctgagaagaccctgggtctagtggacgtgctctacacagctgtgctggacctaaaccgctggagggctggaagggagcaagctttaccctgcatacagatccagctgcaaagggagatctgtgattttggcaaccaggctgacctgccttctggaaatggaaacaaatcttcaggtggcctgcagaagacattctccaaactgacatcccggttcaccaagaaagcttcatgtaccagctccagcagcagcacaaattattccatccaaaataccccttccaaaaacatcttcatagctggatgttccgaagagaaggccaaaatgcctggcaatattgatacaaggttacaaagcattttgaacattggtaatttccccaggactacagacccttcacagtcagctcagaattccagtaatacagtggccaatggctttctcatggagaggcgtgagaacttcctgcatggagatgacggcaaggatgagaagggtatgaacttaccaactgatcaggaaatgcaagaggtgatagattttctctcgggctttaacatgggccagtcacatcagggctctccgttggtgacaaggcataattctgctgccacagccatggtgactgagcagaaggcaggagccatgcaaccacagcagccgtcactgcctgtgccccctccaccacgggcaccccaggctggggcacacacacctctgacaccccagccgggactggcacctcagcagcagtccccaaagcagcaacaacctcaagtccaatactaccaacacctactccagcccattggaccgcagcagcccccgccccagcctcgggcacctgggaaatgggtacatggctcatcccagcagccagcgcaggctgttggagcaggtctgtctcctcttggtcagtggcctggcatatctgatctcagttctgacttgtacagcttgggtctggtgagcagctatatggataatgtgatgtcagaggttctgggacagaagccgcagggacctagaaataacacctggcccaaccgtgaccaaagtgatggagtctttggaatgctgggagagattctgccttttgatcctgcagtgggctcagacccagagtttgcacgctatgtggcaggagtgagccaggcgatgcagcagaagcggcaggcccagcacggtcgccggccaggcaacccccggggcaactggccgcctatggatgacgcgcatcggacctggcccttccccgagttcttcacagaaggggatggcctgcacggtggctggtcgggtgctcagggagactctgccagctcgagtgatgagacatcctcagccaacggggacagcttgttctccatgttttcagggcctgacctcgttgctgctgtcaagcagagaaggaaacacagcagtggagagcaagacaccagcacgctgccctcaccacctctcctcaccacggtggaggatgtgaaccaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccaggccagccagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataatactttgtatccttgtttaaaa

SEQ ID NO: 145793 - DNA, 582 bp, Homo sapiens
  Payload ID: 8912
  Gene Symbol: KIAA0355
  Gene Name: KIAA0355
  ENST ID: ENST00000589583
  CDS Start-End: 489-582
aaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaat

SEQ ID NO: 145794 - DNA, 632 bp, Homo sapiens
  Payload ID: 8912
  Gene Symbol: KIAA0355
  Gene Name: KIAA0355
  ENST ID: ENST00000588470
  CDS Start-End: 400-632
acgtaacttccggtgtacacagccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattcagtctccaggacattgaggtgttggggcgatgtttcctgactgtggtgcaagtccatttccagtttttgactcatgcgttacagaaggtccagccggtggctcactcttgctttgctgaggtcatcgt

SEQ ID NO: 145795 - DNA, 1350 bp, Homo sapiens
  Payload ID: 8912
  Gene Symbol: KIAA0355
  Gene Name: KIAA0355
  ENST ID: ENST00000623152
  CDS Start-End: 874-1350
ggggccggaccggagacgtaacttccggtgtacacagccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgcatgtattgctgcagtgcccaggacagtaaaatggactacaagcggcgcttcctgcttggcgggtccaagcagaaggtgcagcagcaccagcaatacccgatgcctgagctgggccgagcactgagtgctcccctggcatccacggccaccactgcccccctgggcagtctgaccgctgcaggcagctgccaccatgccatgccccacactactcctatcgccgacatccagcagggcatctccaagtatctggatgccctgaacgtcttctgccgtgccagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattc

SEQ ID NO: 145796 - DNA, 582 bp, Homo sapiens; identical to SEQ ID NO: 145793
  Payload ID: 8912
  Gene Symbol: KIAA0355
  Gene Name: KIAA0355
  ENST ID: ENST00000625057
  CDS Start-End: 489-582

SEQ ID NO: 145797 - DNA, 504 bp, Homo sapiens
  Payload ID: 8912
  Gene Symbol: KIAA0355
  Gene Name: KIAA0355
  ENST ID: ENST00000623194
  CDS Start-End: 400-504
acgtaacttccggtgtacacagccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacagtactttcctcacagatctcttcagcactgtgttcaggaactctcactactcaaaggcagccacacagctcaaagatgtgcaggagcatgtcatggaagcagccagtcggctgacctcggccataaagcctgagatcgccaagatgctaatggaacttagtgctggggctgcaaattttacggatcagaaggaattc

SEQ ID NO: 145798 - DNA, 3019 bp, Homo sapiens
  Payload ID: 8912
  Gene Symbol: KIAA0355
  Gene Name: KIAA0355
  ENST ID: ENST00000634164
  CDS Start-End: 1-388
gaaacacagcagtggagagcaagacaccagcacgctgccctcaccacctctcctcaccacggtggaggatgtgaaccaggataacaaaaccaaaacgtggccacccaaagcaccctggcagcacccttccccgcttcccagcacgctgcccagccccagcgcaccactctatgcagtcaccagccctggcagccagtggaacgacaccatgcagatgctgcagtccccagtgtgggccgcaaccaacgactgcagtgccgctgccttctcctatgtgcagaccccaccccagcccccacccccaccagcacacaaggcagcacccaagggcttcaaggccttccctgggaagggtgagcgcaggccagcctatctgccccagtactgaccccaggccagccagcctgcctgcctgcctgcctgcccgcccagagctgtggggatgagtgtccccaccccagggccacttagctgacaccagcccctcagaggaccagtgcgccccatcccagggagggttccttggggacaagggtggttggcagctccaagcctttaaacctggcttctgaaacgatggcatcagagccctggagagccagctggagacacaggcgtctggccttcaggggcttgctagggaacctgcatgcctagtaagcgccacaggtgactctgatgcaggcgccacagccacacttgaagaaacacagctcttgggtttttagtcctgctgtgtgttgggaagacatcaggcctgaaagctgagggcataactgaccattttttggaaaccctctcctccctcctccacaccttgagtgatgaccacaccaatcactgtattttatagctttttttttcatgtaggtttttagttaaaacatctcctgcctaaaatgcattgaatattttaagataacagatatactggctggaggtttgtttaacactatctatatttaagcttatacaaaatgggcaaaatatagaatatttgtgattggaagcagtcacctggggtttctgggggtggacagttcctcgccacccagcagcaccctgggactgcggcctttcccagctttattgaagcagaatggtggaacttgtgccggaggtacactgctgaaggtgcgtggcggtggaccagccagctgctgtccatgtgcagagcaaggctgcacctgctgcccttcgatccttccacacatggccaggacactgccacaatcctcggggtgtggtcaaggggcactcagagacacctgcactagaaattgcattgacattgtgagctggctcagaagacaaaccaattaagatgtagatagaaattaatttaaggtcttttcttaaaaaaaaaatccacctcattttcagttaacatgtgccattaaatagataacatcctgtggatttagggatattttccagccagaatggatccagaagaattgaatggtgcttaaattgagaaataataataaatatatctatatagaatagacatatcccactgtatattaattgaggttacagaaagttctttatataaaacttatttaaatttttcatatttcatctttgaaaaagtctgagaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttctacagatataagtaaatttatatataaaaataccaaaaagaggctgggcgtggtggctcacgcctgtaatcccagcactttgggaggccgaggcaggtggatcacctaaggtcaggagttcgagaccagcctggccaatatggtgaaaccccatctctactaaaaatacaaaaattagccgggtgtggtggcgtgcgcctgtagtcccagctactcgggaggctgaagcagaagaatcgcttgaacccgggaggcggaggttacagtgagctgagattgtgccactgcactccagcctgggtgacagagtgagattccgtctcaacaagaaaaaaaaaaaagaatatatatatatgtatgtatgtatgtatgtaaacacacacactaatttgagaggacccgtagggtgtctgagcccagccacctgagtttttagtactgtgttgtcaggctcttcccaggcctcaggtgttgtcttttgtgctgtgtggggatgcattgctgcctgtatttatgatcttttgccgtggttctgagcattcacctcaccatgtttacaaagaactgttttgtatatagacattttcaggcacgtgctttgcaccaaccctgcgtggctcttgtctgtgttagctgtcacggtgtgcacactaatctctgttaaagttgtctatggctgttctacttgtaagatagttttctatttccttcagtaatgtgtccacagtaccctgtatttcgagttccattatactgaagtactcatgttttaatagtgcctctccaaaggcctcaccttggacagaggtcaatccttgatgctccagcacaggtgacgtcactaattgtcactttccagtttgtttttctctattaaggaagacattttctaattgcatctccatgggctgtgagactgtgtgaagccgtttgtgtggtctccatgtaggtgctgtgttcccggcaccgccttgctctgaacactggtaattccaggtgctgcgcttggcagaggggtctcgccaaagcgcatgtgtgtgcatgtgtgaacgtgtgtgtcctttgcatggttgggcgtgggtgccttgctagggcatcagcaggacattgtgtgtatagttacaatgcttccaaactggaactctacattttgtatcttttaaagctcctataagtaaaataactattggctttattaaaaatatacatttaataatactttgtatccttgtttaaaa

SEQ ID NO: 145799 - DNA, 7391 bp, Homo sapiens
  Payload ID: 8913
  Gene Symbol: KIAA0368
  Gene Name: KIAA0368
  ENST ID: ENST00000259335
  CDS Start-End: 1-6054
atgacctcacggacaaagcgaaggcagaaagttaaaatcagcatatcgaaaataaatcactctagttaccgaaaagaacataggccgttttgggagcaccagccacctccacaccagaactgggctgtcgggggccgctgcggcgcaggggctcgtccgggactgagtcagcgccggggccgagaagttcggcgggaggcgcagggcggggcttcctcccgccgactccgagcccggctctacttttctgagtccacgtctcttcctttggacaggcgtggcagcccgggcccgctcggcccagcccctcacggactgcggcgcgcggctccccggggcccggcccgccgaacgcctcgctctacagccctcacctcgcggcgccgagcgcagcgtccgcggcatggagaccggctccgactcaggtcagaggcccgcccccgggccgcgggggactggccctgcgcgcgcggcggcgcggttaggccgggccgcccgcacaggccgccgcgtgtcgagtccgcgcggggagcgcacgcggggcgggcggcgacagatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcaggatagcttaatgcatcttttaataccaaccctttttcacatgaaataccctgttgaatcatcaaaatcagcttctccatttaatcttgctgagaaaccaaagactgtgcagctgcttttggacttcatgctagatgtccttctgatgccttatggttacgtgttaaatgaatcccagagtcgccaaaattcatcttcagcacagggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacg

SEQ ID NO: 145800 - DNA, 7078 bp, Homo sapiens
  Payload ID: 8913
  Gene Symbol: KIAA0368
  Gene Name: KIAA0368
  Uniprot ID: Q5VYK3
  ENST ID: ENST00000338205
  CDS Start-End: 221-5740
gcgtgtttccccaggtcgggcccagccaacgtgacagccgcagacctcggaaaagggcgctccggccccgcctcgaggatttcccccggccgctagggcagcccgggcccgctcggcccagcccctcacggactgcggcgcgcggctccccggggcccggcccgccgaacgcctcgctctacagccctcacctcgcggcgccgagcgcagcgtccgcggcatggagaccggctccgactcagatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcaggatagcttaatgcatcttttaataccaaccctttttcacatgaaataccctgttgaatcatcaaaatcagcttctccatttaatcttgctgagaaaccaaagactgtgcagctgcttttggacttcatgctagatgtccttctgatgccttatggttacgtgttaaatgaatcccagagtcgccaaaattcatcttcagcacagggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggaggccaagcagatagaacttcagttcactattggcgaagccattaccagtgctgcaataggaactagttctgtggctgcccgagatgcctggcaaatgactgaagaggaatatactccacctgctggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaagtctcatcttaaagaaattcaaagtgcatttgtttcagttctatcagaaaatgatgaacttagccaagatgttgcatcaaagggccttgggttggtttatgaactaggcaatgaacaagatcaacaggaattggtttctacacttgtggaaacacttatgactggcaaaagagttaaacatgaagtttctggagagacagtggtatttcaagggggagctcttggcaaaacaccagatggtcagggcctttctacttacaaggaactttgttctctggcaagtgatcttagccagccagatctggtgtataaatttatgaatttagccaaccatcatgcaatgtggaactctaggaagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtggataaatatttgaaagaaattcttcaagatttggttaagaaccttacaagcaatatgtggcgagttcgagaatccagctgtttagctttgaatgatttattgagaggaagacccttagatgacatcattgataaacttccagaaatttgggaaacgctttttagagtacaagatgatatcaaggaatctgtacgaaaagcggcagaactagctctgaaaactctgagcaaggtctgtgtgaaaatgtgtgaccctgccaaaggagcagctggccagagaaccatcgctgcccttctgccttgccttctggacaaaggaatgatgagcaccgtgacggaagttcgagccctcagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggctgcgatggatagtgctcggcttagtgctgccaaatcttctccaatgatggaaacaatcaacatgtgcctgcaataccttgatgtgtcagtgctgggcgagctagttcctaggttgtgtgaactgatcagaagtggtgtaggtcttggaactaagggtggctgtgccagtgtcattgtgtcattaactactcagtgtcctcaggacctaacaccttactcaggtaaacttatgagtgctttgctgagtggcctgacagatcggaacagtgtgattcagaaatcttgtgcatttgctatgggccatttagttcggacctcacgggatagcagcactgaaaaactcctgcagaagctcaatgggtggtatatggagaaagaagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgttgttatcgtcaggagctgtgcaaactgatgtgtgaacggctaaaactcagcacgtggaaagtgcagctaggagtcctgcaatcaatgaatgccttttttcaggggttaatgcttttggaagaagaacatgccgatcctgaggctttggctgaaattctgcttgaaacttgtaaatcaatcacatattctttagaaaataagacctactcatctgtgagaacagaagctttatctgtgatagaattgctgcttaaaaaacttgaagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacga

SEQ ID NO: 145801 - DNA, 573 bp, Homo sapiens
  Payload ID: 8913
  Gene Symbol: KIAA0368
  Gene Name: KIAA0368
  ENST ID: ENST00000374383
  CDS Start-End: 1-429
actattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggaggagctattgaaagccattgcctgtgtggtgacagcttgcagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaa

SEQ ID NO: 145802 - DNA, 2806 bp, Homo sapiens
  Payload ID: 8913
  Gene Symbol: KIAA0368
  Gene Name: KIAA0368
  ENST ID: ENST00000602447
  CDS Start-End: 137-2806
ggcgggcctcggggcacagcgcggtccgcgccgagtgaacggaggcggctcgcggcccctgccgcaccgcgagccgcgagccccccggccgcgccctgcccccccagcccctccctcgttccctccccggcgcaacatggctgcggccgccgcctccgcctcccaggatgagctgaatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcaggatagcttaatgcatcttttaataccaaccctttttcacatgaaataccctgttgaatcatcaaaatcagcttctccatttaatcttgctgagaaaccaaagactgtgcagctgcttttggacttcatgctagatgtccttctgatgccttatggttacgtgttaaatgaatcccagagtcgccaaaattcatcttcagcacagggttcttcttcaaacagtggcggaggttctggaatcccacagcctcctccgggaatgagcttttatgcagccaaacgagttattggtgataacccatggacacctgaacaattggaacagtgcaaattgggaatcgtgaaattcatagaagctgaacaggtgcctgaacttgaagctgttctccacttggtgattgcctctagtgatacacgccacagtgtggcaacggcagcagacctggaattgaaaagcaaacagagcttaattgactggaataatcctgccatcattaataagatgtacaaggtgtaccttggagatataccactgaagacaaaagagggtgcagttctgaagccagagttgaaaagggaccctgtcagtacaagagtcaagttaaagattgtcccccatctcctccgctctagacaagctgctgaaacgttcccagccaacattcaggtggtgtatgatggactttttggtacaaatacaaattcaaagttaagaacattatccctgcaatttgtgcatcatatttgtataacctgtccagaaatcaagattaagccattaggtccaatgcttttgaatggcctcaccaagctaatcaatgaatacaaagaggaccctaaactactgtcaatggcatattcagctgttggaaaactctccagtcggatgccacatttattcactaaggatatagcgcttgtgcagcagctttttgaagccctttgcaaggaagagcctgagactcgacttgctattcaagaagctttatctatgatggttggagcgtatagtactttggaaggggcacagcgaactctcatggaggcacttgtggcttcgtacttaataaagcctgaagttcaagttcgacaagtggctgtgaaatttgccagtacggtgtttccctcagatcatatcccttccagatatttgctgctactggctgcaggagatccacgtgaagaagttcatggagaagcacaacgcgtattaaggtgtcttccaggtagaaacagaaaagaaagtacttctgagcagatgccttccttcccagaaatggtttattacatccaagaaaaggcttctcatcgaatgaaaactccagtcaagtacatgaccgggaccactgtccttccatttaacccagcagcctttggagagatcgttctgtacttgcgcatgtgccttgcgcacagtgcgggggtggtgcccacctctcagagtttggctgatatgcaggatcatgccccagccattgggcgctacatacggactttaatgtcaagcgggcagatggcaccctcatcatctaacaagagtggggagactaaccctgtccagatctacattggcctgcttcagcagctgttagcaggtgttggaggtttgccggttatgtactgtctattggaagctgtgtcagtgtatccagaaaagctggctaccaaatttgtagacaaaacagaatggataaagagtctgatgaataacagtaaagaagaaatgcgcgaactggcagcgttgttttattctgtagtggtatcaacagtgtcggggaatgagttgaaatcaatgatagaacagcttataaagactacaaaagacaatcacagcccggagatacagcatggatccttgcttgcattgggattcacggtgggaaggtatttggctaaaaagaaaatgagaatgtcagagcaacaagacctggagagaaatgctgacaccctccctgatcaagaggaactcattcagagtgctacagaaacaataggctcatttttggacagtacatcacccctcctggcaattgctgcctgcacagccctgggtgaaattggcagaaatggtccacttccaatccccagtgagggatctggctttaccaaattgcatcttgtagaaagcttactaagtagaataccttccagtaaagaaacaaataagatgaaagaacgagcaatccaaacactgggatattttccagttggggatggagattttcctcaccagaaactcctcttgcaaggtctgatggattctgtggag

SEQ ID NO: 145803 - DNA, 539 bp, Homo sapiens
  Payload ID: 8913
  Gene Symbol: KIAA0368
  Gene Name: KIAA0368
  ENST ID: ENST00000602978
  CDS Start-End: 156-539
aggccgggccgcccgcacaggccgccgcgtgtcgagtccgcgcggggagcgcacgcggggcgggcggcgacagattctttatacaattgcatatgtacgagtggatgaacgtaccattggtgatcccgaggatttttgtcaagattggataaaccatgtatcacattgattgtagagatcagcttgaacgggtctttttacgacttggccatgctgaaacagatgaacaattacagaatattatatctaaattccttcctcctgttttgctcaaactctctagcacccaagaaggagtacgtaaaaaggtaatggaactgctggtccatctgaataaacgtataaaaagccgccccaaaatacaacttccagtagagacactgttggttcagtaccaggaccctgctgcagtttcctttgtcacaaattttactataatttatgttaaaatgggctatcctcgcctaccagtggaaaaacaatgtgaactggcccctacgcttcttactgccatggaagggaagcctcagccacagcag

SEQ ID NO: 145804 - DNA, 6118 bp, Homo sapiens
  Payload ID: 8914
  Gene Symbol: KIAA0391
  Gene Name: KIAA0391
  Uniprot ID: O15091
  ENST ID: ENST00000250377
  CDS Start-End: 367-2070
gtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggcttactattcatagcagtttttaattacttatcatccaattatttggattggagaagagggggcattcactcctctttttcttattttttttggaaatagagtctcaacttactctgtcgccagggctggagtgcagtgacgtgatcacagttcactgcagcctcaaactcccaggctcaagcaatcttcctacctcagccctcctgagtaattgggactacaggcatgtatcaccaggcttggctaatttttttttttttttttgtagagatggctgtctcactctgttgacaagactagtctccaacccctggcctcagtcgatccccagcaatttgggagattgaagcgagagaatcacttgagtctaggagttcaagaccagcctaggcaacatagtaagatctcatttctacaaaaaatttaaaaattagccaggcatggtagtttgcacacatagtcccagctactttgggggctgaggtaggaggattgcttgagcctcagaggtcaaggctgcaatgagccaacgttgcaccactgcactctagcctgggtgacagagcgagaccttgtctcaaaacaaaacaaagtgctggaattgcagacttgagccacagtgcccagcctcacttctctagactatgatggttttttcttcattctataatctcttttccaaattggttcaacattttgtgaacactattaatttcatcattcagtatatgtgggctttctaaaatatgccaatttttttccacttaatcaagtttgacttaatttaacaaagtgattatattttaatagttacatttctgttttttccactcactagccagcttacagtttattagcccttgatttcagctgaaaatattcatgtctgcaccccttcatgatagttctttctttacgtatacatactgtattcaatatgcaagaacaggcaaaaactactctattgtgataaaaatcagaatagtaattgcctgaggaaagggatatgagagaacttgagagaactttctcggggtgatggaaagtttcttatattgatttgggtaatagtaacatagctatatgtatatattagttaaaattcctcacactaaacattttaaattgatatatttacatttatgacaatatacctcaaagtaagttagggtaagaaaagataattacttacatgaaataaacaatgacctcttttatatcaaaccatatacatgtgtataattagggtatgtattatgcacagagaaacaatttaggaaaatccaaggaggggacgttttatcttcttacctatttactgaatgcaacattactgcacaccaagacaaaagagctctccaggaaaacattggatatattgagagcattaaaagatactgcaaaagctctaataaattcagtctgcttattttccaaatttcataaactacatacttaggaaactgtgctttcagtgagctaaacttctttttttaagtaactatcatagttttaagaaaaacattttaagaagacaaaaagtatttattaagcccatctaaaaggctaatgcaaattcccaaaaaaggagcacatagagatagaggaggaggccgaagtggtggctcatacctgttaattccagcactttgggaggccaagacaggaggatcactttaggcccagagttggagaccaacctgggcaacatagcaagaccctgtctcttaaaaaaaaaaaaaaaagacgggagaagctacaagaagaaaactagaactttagagcaggagtaaccttagagcatgtaaagtccattttggagatgaggaacagacccaggaagatgacctggcttccctgaatcccacggctagttagtgcagacatttcagccataacccagctcttctaattcccaaatactctttcttctactggcacatagagatgggggaggagtcagggcatggtggcccacacctacagttccagcactttgggaggccaaatgggagaattgcttgaagccaggagttggagaccagcctaggcaacacagggagacccgtgtcgacaaaaaatttaaaaattagctgggcatggtagcacatgcctgtggtcccagctactcagaaggctgaggtgggaggatcacttgagccccagaggtcaaggctacagtgagctatgatcatgctactacactccagcctaggtgacagagtgagaccctgtctcaaagggagggaggtaagaatgagaagaaggaacaggggtgtacctcttttaagggcccaagtatcctgaatggctcagcagtatagaacattgtggtagagaaattacattttaaaataactctaatactgtttagaaacaaaaccctaacttctgcttgagataaactgaagtgcatctgtcccttgtccaggagtggggaaccattgtagggttgctcagcataagtcatactgccacggtgaccttgaggagtgcagggattccctgaaggaagcagctggtaccagacacttaggctgcccatttgtgttctgatcatttgagtgaaaaaaaggtacctgtcaagcaagctcctggacaccacaagaaggaggaattattttaaaagctgtactcttaaattgttagtatctttaaaatcagttgtgaacaatgaaggatttgaaagagcattgactttgccacttaaaagtatttctaaaatactttgtgcttcccccttgcattctgaatttatacacttttcctcctgctgttctcagacccagtggaaagaaaatctcaaggaagaaggctgagtttattctctcagggctctgttgggtctacctcatctgaggtggcttattcttcataggaaattaatttttcttctcaagtatgcacttaaatataattactgcttccttggtcctctagcagatttctcacttttatttatttttttttttgagacagagtcttgatcttttttcatctaggctggagtgcaatggtttgatctcagttcactgcaacctctgcctcctgggttcaagcaattctcatgcctctgcctctcgggcagctggaattacaggcatgcgccatgacgcctggctaatttttgcatttttagtagagacgggttttcaccatgttgccccggttgctctcaaactcctgacctcaggtgatccacccacctcagcctcccaaagtgctgggattacaggtgtgagtcaccccgcacagcctgaaatgaggcatctctatctatagtccagcagccctacaggaggcaggaggggagcaagaataagaaaggaaatttgtaaaaggcacttaggagtgagcagaaaggaaataggaccagcttttacctgcccagtcctggccagtgacaagcagtctgcttgagtctgtgctaaataaacaaaggaagttccatttagagctctacagaggggaagccatagaaattaacaggatgaaaatacaagagacaggaacacagatgaataaatgtaataaaatttgagaaat

SEQ ID NO: 145805 - DNA, 1589 bp, Homo sapiens
  Payload ID: 8914
  Gene Symbol: KIAA0391
  Gene Name: KIAA0391
  Uniprot ID: O15091
  ENST ID: ENST00000321130
  CDS Start-End: 442-1077
agtttccgccgcgtttatggccgcgttaagtctgagtgccgctttgagttgttgaatgaagtgaacttcatttgtcagcgttcggtacgcagtctaggcagcgcccttcctgtacctctcttcctttcctgagtcgttggcgcagctgactcgccacctcctccctcctcgtccccccaccggaggagttttgcggtctgtagagagctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccactggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggcttactattca

SEQ ID NO: 145806 - DNA, 2611 bp, Homo sapiens
  Payload ID: 8914
  Gene Symbol: KIAA0391
  Gene Name: KIAA0391
  Uniprot ID: O15091
  ENST ID: ENST00000534898
  CDS Start-End: 361-2112
ggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaa

SEQ ID NO: 145807 - DNA, 789 bp, Homo sapiens
  Payload ID: 8914
  Gene Symbol: KIAA0391
  Gene Name: KIAA0391
  ENST ID: ENST00000557404
  CDS Start-End: 235-789
ctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccactggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcac

SEQ ID NO: 145808 - DNA, 2232 bp, Homo sapiens
  Payload ID: 8914
  Gene Symbol: KIAA0391
  Gene Name: KIAA0391
  Uniprot ID: O15091
  ENST ID: ENST00000603544
  CDS Start-End: 425-2128
ttcctgagtcgttggcgcagctgactcgccacctcctccctcctcgtccccccaccggaggagttttgcggtctgtagagagctatgcagggtgagggcccctagacttcggctttcgccgctgttggtggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagat

SEQ ID NO: 145809 - DNA, 1406 bp, Homo sapiens
  Payload ID: 8914
  Gene Symbol: KIAA0391
  Gene Name: KIAA0391
  Uniprot ID: O15091
  ENST ID: ENST00000605870
  CDS Start-End: 320-955
gtccccccaccggaggagttttgcggtctgtagagagctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccactgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatcca

SEQ ID NO: 145810 - DNA, 1706 bp, Homo sapiens
  Payload ID: 8914
  Gene Symbol: KIAA0391
  Gene Name: KIAA0391
  Uniprot ID: O15091
  ENST ID: ENST00000604948
  CDS Start-End: 116-1582
actgtagtttccgccgcgtttatggccgcgttaagtctgagtgccgctttgagttgttgaatgaagtgaacttcatttgtcagcgttcgctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagc

SEQ ID NO: 145811 - DNA, 552 bp, Homo sapiens
  Payload ID: 8914
  Gene Symbol: KIAA0391
  Gene Name: KIAA0391
  ENST ID: ENST00000604073
  CDS Start-End: 494-552
gagttcattagttccggcttgagggaagcgccttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccatacct

SEQ ID NO: 145812 - DNA, 578 bp, Homo sapiens
  Payload ID: 8914
  Gene Symbol: KIAA0391
  Gene Name: KIAA0391
  ENST ID: ENST00000605201
  CDS Start-End: 509-578
tttccgccgcgtttatggccgcgttaagtctgagtgccgctttgagttgttgaatgaagtgaacttcatttgtcagcgttcggtacgcagtctaggcagcgcccttcctgtacctctcttcctttcctgagtcgttggcgcagctgactcgccacctcctccctcctcgtccccccaccggaggagttttgcggtctgtagagagctatgcagggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcc

SEQ ID NO: 145813 - DNA, 603 bp, Homo sapiens
  Payload ID: 8914
  Gene Symbol: KIAA0391
  Gene Name: KIAA0391
  ENST ID: ENST00000603611
  CDS Start-End: 502-603
acctctaggagtttagggccgggccatcccaacgggctgcccctcccaaaactcactgtttggacaggtgttgggcgtcgctaggcgccgacgaagaacttctttccagtccatggccgacttccgcgcagcagcttctgcatttgctgtttcctacctgctccacccctaccagctcaggcgtcagcaccgccaggccccgtaaaggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggca

SEQ ID NO: 145814 - DNA, 1068 bp, Homo sapiens
  Payload ID: 8915
  Gene Symbol: KIAA0408
  Gene Name: KIAA0408
  ENST ID: ENST00000487331
  CDS Start-End: 312-1068
gaaggtttcaaagggacttgtcagtactgctctgtggaatggttggacttattttgcatccccttttcttgtaaagaatcgagattcaccgagctgagacttttctctttaagacagctagccatccactttcttccactgctaattgaccagtggtcgagcatccataggatttctccccagtgtgaaaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagaggcatcaactctagtgcttctctcaactgagttatcgctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaacaggaagaatctgagctgta

SEQ ID NO: 145815 - DNA, 3284 bp, Homo sapiens
  Payload ID: 8915
  Gene Symbol: KIAA0408
  Gene Name: KIAA0408
  Uniprot ID: Q6ZU52
  ENST ID: ENST00000483725
  CDS Start-End: 338-2422
gcagctttttgacttgtaaaagtggtgaaggtttcaaagggacttgtcagtactgctctgtggaatggttggacttattttgcatccccttttcttgtaaagaatcgagattcaccgagctgagacttttctctttaagacagctagccatccactttcttccactgctaattgaccagtggtcgagcatccataggatttctccccagtgtgaaaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaaagtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaacaggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaa

SEQ ID NO: 145816 - DNA, 3449 bp, Homo sapiens
  Payload ID: 8915
  Gene Symbol: KIAA0408
  Gene Name: KIAA0408
  ENST ID: ENST00000465254
  CDS Start-End: 1-267
agctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatggagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccgaaaaaaggcttaaactaaaccttgacatccacagtagcatcaggaatagaaatgtgtattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctatataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaac

SEQ ID NO: 145817 - DNA, 7743 bp, Homo sapiens
  Payload ID: 8916
  Gene Symbol: KIAA0430
  Gene Name: KIAA0430
  Uniprot ID: Q9Y4F3
  ENST ID: ENST00000396368
  CDS Start-End: 208-5436
gggcggtgcggtgcggaagcggaagtgaagggtgcgcttggcggcggcggcgggagctgcggagtcgggaatcaaaacaaagggcctggggggggcggggggaaggcggcggggccggaatgtgagcggaggtggagccggcggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatctat

SEQ ID NO: 145818 - DNA, 7105 bp, Homo sapiens
  Payload ID: 8916
  Gene Symbol: KIAA0430
  Gene Name: KIAA0430
  ENST ID: ENST00000540441
  CDS Start-End: 66-4799
ggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccagagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 145819 - DNA, 581 bp, Homo sapiens
  Payload ID: 8916
  Gene Symbol: KIAA0430
  Gene Name: KIAA0430
  ENST ID: ENST00000549219
  CDS Start-End: 89-581
gcatttgtgtcttttggacttctctgagcgggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcag

SEQ ID NO: 145820 - DNA, 600 bp, Homo sapiens
  Payload ID: 8916
  Gene Symbol: KIAA0430
  Gene Name: KIAA0430
  ENST ID: ENST00000551878
  CDS Start-End: 1-59
cctcggaactcaagcttggagctgacggcagtggcttagaaggaaaacttcaggtgtgagcccagggtgtgtgctgggggtgggcgtggaggtcctgtggtgtcacggccctccttgtttgcccagggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaa

SEQ ID NO: 145821 - DNA, 5053 bp, Homo sapiens
  Payload ID: 8916
  Gene Symbol: KIAA0430
  Gene Name: KIAA0430
  ENST ID: ENST00000552553
  CDS Start-End: 1-3114
atgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaa

SEQ ID NO: 145822 - DNA, 5891 bp, Homo sapiens
  Payload ID: 8916
  Gene Symbol: KIAA0430
  Gene Name: KIAA0430
  Uniprot ID: Q9Y4F3
  ENST ID: ENST00000548025
  CDS Start-End: 150-5369
gcggagtcgggaatcaaaacaaagggcctggggggggcggggggaaggcggcggggccggaatgtgagcggaggtggagccggcggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggt

SEQ ID NO: 145823 - DNA, 5900 bp, Homo sapiens
  Payload ID: 8916
  Gene Symbol: KIAA0430
  Gene Name: KIAA0430
  Uniprot ID: Q9Y4F3
  ENST ID: ENST00000551742
  CDS Start-End: 150-5378
gcggagtcgggaatcaaaacaaagggcctggggggggcggggggaaggcggcggggccggaatgtgagcggaggtggagccggcggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccatgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagcaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggt

SEQ ID NO: 145824 - DNA, 7743 bp, Homo sapiens; identical to SEQ ID NO: 145817
  Payload ID: 8916
  Gene Symbol: KIAA0430
  Gene Name: KIAA0430
  Uniprot ID: Q9Y4F3
  ENST ID: ENST00000621511
  CDS Start-End: 208-5436

SEQ ID NO: 145825 - DNA, 5053 bp, Homo sapiens; identical to SEQ ID NO: 145821
  Payload ID: 8916
  Gene Symbol: KIAA0430
  Gene Name: KIAA0430
  ENST ID: ENST00000633811
  CDS Start-End: 1-3114

SEQ ID NO: 145826 - DNA, 5891 bp, Homo sapiens; identical to SEQ ID NO: 145822
  Payload ID: 8916
  Gene Symbol: KIAA0430
  Gene Name: KIAA0430
  Uniprot ID: Q9Y4F3
  ENST ID: ENST00000632465
  CDS Start-End: 150-5369

SEQ ID NO: 145827 - DNA, 5900 bp, Homo sapiens; identical to SEQ ID NO: 145823
  Payload ID: 8916
  Gene Symbol: KIAA0430
  Gene Name: KIAA0430
  Uniprot ID: Q9Y4F3
  ENST ID: ENST00000632628
  CDS Start-End: 150-5378

SEQ ID NO: 145828 - DNA, 581 bp, Homo sapiens; identical to SEQ ID NO: 145819
  Payload ID: 8916
  Gene Symbol: KIAA0430
  Gene Name: KIAA0430
  ENST ID: ENST00000633837
  CDS Start-End: 89-581

SEQ ID NO: 145829 - DNA, 600 bp, Homo sapiens; identical to SEQ ID NO: 145820
  Payload ID: 8916
  Gene Symbol: KIAA0430
  Gene Name: KIAA0430
  ENST ID: ENST00000633549
  CDS Start-End: 1-59

SEQ ID NO: 145830 - DNA, 7098 bp, Homo sapiens
  Payload ID: 8916
  Gene Symbol: KIAA0430
  Gene Name: KIAA0430
  ENST ID: ENST00000631398
  CDS Start-End: 59-4792
ggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccagagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatcta

SEQ ID NO: 145831 - DNA, 7404 bp, Homo sapiens
  Payload ID: 8917
  Gene Symbol: KIAA0513
  Gene Name: KIAA0513
  Uniprot ID: O60268
  ENST ID: ENST00000258180
  CDS Start-End: 274-1509
tcgcgccgcggcgccgggaaaggacccggctgctcgcgggcggcgcagtcgccgcagcagccgagtctgacggcgccggttcgctgcccggtccgcccgcgatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagaggggatgctggagaggaggaggagaagagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggcgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgagggttgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccggctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcactctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcctgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaacttt

SEQ ID NO: 145832 - DNA, 7381 bp, Homo sapiens
  Payload ID: 8917
  Gene Symbol: KIAA0513
  Gene Name: KIAA0513
  Uniprot ID: O60268
  ENST ID: ENST00000538274
  CDS Start-End: 281-1486
tcgcgccgcggcgccgggaaaggacccggctgctcgcgggcggcgcagtcgccgcagcagccgagtctgacggcgccggttcgctgcccggtccgcccgcggtgagagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggcgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgagggttgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccggctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcactctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcctgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaacttt

SEQ ID NO: 145833 - DNA, 675 bp, Homo sapiens
  Payload ID: 8917
  Gene Symbol: KIAA0513
  Gene Name: KIAA0513
  ENST ID: ENST00000562580
  CDS Start-End: 1-597
aagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccac

SEQ ID NO: 145834 - DNA, 364 bp, Homo sapiens
  Payload ID: 8917
  Gene Symbol: KIAA0513
  Gene Name: KIAA0513
  ENST ID: ENST00000562564
  CDS Start-End: 1-342
gacgagaacaaaccccaggagaagcggcccagggctgtgaccgcgtacagccccgaggacgaaaagaagggggagaagatctacctgtacacgcacctgaagcaacagcccatctgggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgca

SEQ ID NO: 145835 - DNA, 1873 bp, Homo sapiens
  Payload ID: 8917
  Gene Symbol: KIAA0513
  Gene Name: KIAA0513
  Uniprot ID: O60268
  ENST ID: ENST00000567328
  CDS Start-End: 221-1126
ttctggtgaggagtggcgctaatgtctgtgtctgtgtttccattctagatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggtaaggccgagcccgcggcttcccgtcaccctcttactgacggggccagcagtcactccccgggatcacttctagctgcctttgtccccatcagaatggcagaattctcacactcaccagagtggcagaataaaaagatgaacactcacaggcgttggtgaggatgtggagaaactggagctctcctgtatggctaggagcaatgtaaatgagcagccgctgagaaacagtctggcagttcctttaaaggtgaaacacaagagttactctgtgacccagcagctccactcctaggagtcgcccaagagaaaaacatgtcctcacaaaaccttgtacacaaatgtctgtagcaacgtcgtttattatggccccgaggtggaaaccaccttcatggctgtccagtgatgaatgggtaaacaaaatgtggtccatccgttgcatggactattagccagccatgaaaagcaatggcatgctgctccacgctgtagcagggatagacctgggaaacatcgtgaaactcagtggaagaagccagacacagaagcccaagtattgtatcatccctatgaaatgtccagaactgcagattcctagagacacagcagatgacagattgcccgggcagagggtggggaatggggagcagggcgtgactgctgatggggatggggcttctttatggggtgagagaatgttctggaaatggtggtggctgcacaactctgtgaatacactaaaaatcactgaa

SEQ ID NO: 145836 - DNA, 7772 bp, Homo sapiens
  Payload ID: 8917
  Gene Symbol: KIAA0513
  Gene Name: KIAA0513
  Uniprot ID: O60268
  ENST ID: ENST00000566428
  CDS Start-End: 632-1867
caagagtgcctgaggctggatcagaaatagccacgatcgtccagtttgattgattgattgattgatttagttgtgatggagtctcgctgtatttcccaggctggagtgcagaggcacgatctccgttcactgcagcctccacctccccggttcaagtgattctcctgcctcagccttccgagtagctgggattacaggcacctgccaccacgcccggctgatttttgtgtttttagtagagacagggtttcgccatgttggccaggctggtcttgaactcctgacctcaggtgagccacccgcctcggcctcccaaagtgttgggattacaggcgtgagccactgcccccagccccagcttgatcttgaacctcctgtgtgtgggcagagagacatggccctgctactgcttgaacggcttccggagacagtgacttgtttcctttttccctctgaactatgccgtagggccaggtgagctgctgtgaaggactcattcttggtagccggcagttactggcaacttgtgagcttggtgggctcctactaacgcacctgggacaccaggctgctgggctcccctctaggcagcctcccctccaggcagcctcaccagcagctcccctgagccatggagaccccagaggtccccgtgggctcgctaatcgactttgggcctgaggcacccacctcttctcccctggaggcaccaccccctgtgctgcaggacggcgatggctccctgggggacggtgcatcagagagtgagaccactgagtctgcggacagtgagaatgacatgggcgagtcgccctcgcacccgtcctgggaccaagaccgccgttcctcctccaacgagtccttctcctccaaccagagcaccgagtctacccaggatgaagagaccctggcactcagggacttcatgcgtggctacgtggagaagatcttctctggaggggaggacttggatcaggaggagaaagccaagtttggagagtactgcagcagtgaaaatggaaaaggccgggagtggtttgctcgatacgtgagtgcccagcgctgcaactccaagtgtgtctcagaggcaaccttctaccgcctggtgcagtcttttgcagtggtgctgttcgagtgtcatcagatggatgactttgggcctgccaagaacctcatgaccatgtgcttcacctactaccacatcggaaaaccacagctgctgcccccggagtcccgggagaagcccgcgggcagcatcgactcctacctgaaatccgcaaacagctggctggccgaaaagaaggacatcgccgagcggctgctgaagaacacctcggccaggactgagaatgtcaagggcttcttcggggggctggagaccaagctgaaggggcccctggccaggaggaacgaggaagacgagaacaaaccccaggagaagcggcccagggctgtgaccgcgtacagccccgaggacgaaaagaagggggagaagatctacctgtacacgcacctgaagcaacagcccatctggcacactctgaggttctggaatgcagccttttttgacgctgtccattgtgagaggacaaagcgatctcccactaccagaggggatgctggagaggaggaggagaagagggagaagtggtgccacatgacccaggaggagcgcgacgacagcctccggttcaacgagaacatcaccttcgggcagctgggcacattcacgcacaacatgctggcctttggactgaacaagaagctgtgcaatgacttcctgaagaagcaggctgtgattggcaacctggatgaagagcaatacaagctgcttagtgaccacattgagcaaatggccactgagtaggccccagaggtcgcactccgcaggaggactgaggccatgtgccattctcccgggcccagcgcccggccgtcaccccacccgatgacctgcatgaagccagcagcacccagagccactcctgctgccctagaactagcggttagaagaatccgctgttcctccctcatctcctctgcctgtgtctgcgacccccatccatgtgccaaagtgtcccttgggtcacacagctaaagccgaggtgaccagttgtaccccgagtgccaggcttgtgagatgagaccaagagggaggaggggaaggactccatgggccatcgtgggccaagggctggcgagggtgggggcgggcaagggatgcaggcaggacagccatgaggtggggctgcagccggcacacccagtggtggagggccggcgctgccactcacggtgggtggccgtgggccaccttccctgcaatgggtgcacacgcggctcccatccagccctctcagcgtggggctgtggctggtcctcactattccccagtctcccgctgtggggcaggaacaggaagtgacgggaaccttgaggaggaaacgcctgtgttagggagagagtgggtgcggtgtagaggatgctcttggccggctggagcaagacctggctcccaccagagggacgtgtgtgtgcctgcagacggcccgggagctgtgtgtctccgccagagtcacagcagtgccgaggtgtccgcggcagaccacacagaccgtctgaaatgcgcccgcctggcggacagctcccttctgaagcagagaagcctccatggtcacgaagcagcgttgtgctgtgtgtccctcgcaagaagcacaggaaagagaagtttctttagtagccactagacaaccaccctttctgaaagcaaacagtgctgctctttattccagacaaggcaggaaagtctgagttgggagtgacagtggctggagagaagcagatctgtgcaacgtgcagggcaagccagtggcgtggcctctgcctctaagcgctgagcattgggccccttccccaccagacctttgtagctcctccagcctctgcagagactcccttcacctcgcacttactgcctgggaaccacggcccttctcttctgtgggtctgtaccaggtactccaggccagcccatgggcccggggcctgaccccaacacctgcatgctgggtccagagccttctgtttcaccgtgcgtggacactgctaggccgcctggggtcccctgcctcctgcctgtcgctgccgtggtccctgactgcgaaataggcccgcggggctctccctcctcctgccatcctcccctcccgcccttcctggctacctcctctgacatgcggtcagataagtcccgtcttgtttgtgagtaccacagaaacgcctgagagtcacttacccggccactgcttggaaggtttccctccggggaatgcctccctggaatgttccagagacggaacattctctagagacaacagtctgtgctgcagattggttggatcacagaatgtgtgtctggggcattatctgaaacgtggtgtcatctgatgcatttggaccatatgctgccagactgcagaacgggggagccggggctcagggcccctgactgcatggtgcatgagtgatctcagcctagcgatgccgctggccagaccgtgaccatgctgccagtgtgctcgccatgagctgggtcagggctggggagttgtgcaggctggggtgacccttcccccatcattgggccccaacgggcatgtctccaccgaatccatttagagaaatgtcagagcgagggttgtgtggacacccctcgctctgatgccaactgcagataatacacacctcctgcagcgtccagccacggctccagggcactgctctcctccttgcaccggtgaaactcaggccacactcaagggctgactgtccaggcgctcccttcagccgcctcgtcgtcagcgttcttagtcatgcattattcgtgttagctgaaatgcattcagactttgttctgcggtgcccacaggacttacccctgtatgtacaggatttttgtatgaaagttttgtttgattctgagactctcttgggaacgctggagagcttgtgcacagcctctggaaggaaaggcagcgctgacttcgttgggcttttttccaagcactttaacttcagaaatggtcttgacacttttttctccacatagactcttgaaatagccatttcaggggaggaaagggttggggttttctttgtttgtttgtttgtttccccctttactacctgttcttgtagatctagctcctcagagttggaggaaggctgacagagaaggtctcctctgtgctccatccacacaggatgccggagagacagccccttgtgctgtgagcagagcaggcagtggctctggaggctgcctgtggtctccttccggctgtggctgacagtggctctggccagggttgcttggagaaggctcagtgtgcctgggacagggcttaccacctgccaccaaggtttcctctcttcccccaggacctgggcagagcaggcatgagctgggctgtggtgcagagcaagcagacccagccacactgctcaaaggtccctgcgtggggaggtgtcacaccaggggcacacccagggccacctgggtgtaggagagctctggtggcccctccgtaaactcaggaagtgtcaggtgatttcctagggagaggttcccagtcccagcaggcagaatgcccaaaaccaggagcacgaaggcctgtcatccatggggccattgcaggcactctgccgcccgaccttgagggctgtgccaatcctagtgaaccaaaatgcaaacaactcacacaagtgaaaagctccctgctttgaaaacaggacatgttgacaggcagcatggtatgtttttagcctttgttacagttttagcaacattgatgtctaagaggggccgtggtaatagattgcatctgccctgtgcatgcgcatgtttaaccacaggccagagaactcaattctgatgtcgtaagttctctgtaagtgaaatggggtagactgtatgattttcctattgccaaaagaaagaaagggggccaaacagctctgaaatttccaaaaaatggctagagggagagtccagtttctgagctctgtacccaaattaaaatcctgatgttcaggttaatccaagcaacacgcattgggtttaaaaccagcaccgaggcccagtgggggaatcacagacatcaccaagtctcgtcttctttccttcctgtgagttgaaaccaaacaggcctctcgctcactcctcccagcccagtaatgctgaggagttcagttgtgaggaaagaaggctggagctgtgagattcgcttttccctaggctgttccgcgtgggttaccttatcaccctggagcacttggtattccagacccctgacatgaggaatgcaggttcacactgtaaagagtttgtgaaaggtttcagtctaactggggttccttagctggaagccagggctggaagctacaggcctgaccttcctgggtcccactatctgttggcattttttttttttttttttttttagacggagttttgctcttgttgcccaggctggagtgcagtgacacaatctctactcactgcaacctccacctcccgggttcaagcaattctcctgcctcagcctcctgagtagctgggatgacaggtgcacgccaccacgcccggctaatttttatatttttggtagagatggggtttcaccatgctggccaggctggtctcgaactcctgacctcaggtgatcccccccacctcagcctcccaaagtgctgggattacaggcgtgaggcatcacacctgcctctgttggctttttagttaggaaggatccagctaggcccgtgtggttagatcagctttgttactgaattacctaaaaccagaccacagcacagccagggagcccagtagtgtttccaagaacagtgtggagcttgagaaagagaactttaaaaattagagggtccctttctgcagaggaagggatgctcgcagggtggcagtggcccagccccagcctcagggacggggagggagagccccctctgggcccagcaggcaggtgttctgaggctggtccctcctcagtttccgcagccacaaggcgaaacggccagattctcactcaaggtcgttctcactccttttcctgtcccgtttccagtcccactgagccattcacttctgctgaaccatttttcttaggatgcagccgtctcactcccttgtcctgtaaatcgtgtattcatgttgatgattcttggagataggtttcactttttcccagctgcgtccacaggaaaggggagtcggatgccagctgcaccccgcctggctcgcacaggctaagaccacagacagagcagggcttcccggagccacacaggccacgcaccccaggaacccttgctgccgcgggccaggaacaggaatgtgttggtgcctgagacaccaaatggaagaagcacatcaagactgttctcctgcggccaacactggcccggaagccgccctccatacaggccctcagggggcctgccttctgcgcctcagtcccccgtgcatccctgggcctgggtatcacatgctctccaggaaagggacggaatcaatcctgtgaccgatgggctcgcaaggatgggtgccgccgtgggagccctgcctctggtgctggcaagggattgggtttgtgtgggtgtctctagcctgcagagtgcagtgagtgagagtccttgggagcgcggcgctgcctgtagctgtgcctggggatgcacgtggccacgggatttcagtgggacagcgctcccacaggggctgggggtgggggtggggtttcttagttactgttggaaagggaaaaattcaccatatccaaggggagagacgatgggctgggtttgtttactccaacttcccttctacacccctcctgcaggacagtacgatttggggagaacccagctccccactttatctgcagactctgggacctgacaaaacagtcagagcctgagtgcactgcagcctgaactcccttgagcagcgctataagggactttgcactttaaaaaggggatgcctgtcagtaaatcccctgtgcattgactagaactggggggctgcgcccgctccctccttaatcctagatgatttgctcatgaaatagaggtgggggacgaccgcatgcactctgggaggtgcagccctaaggggtggactccagatctccctgcaagagacagcttggcttggctttggctgttggggaggagtccctgccatcccggtgagcctggggctgttgcttagggtcttctgggtggacacgtggagaaagagaaggcaaacgttggaacactaggaaaagctagaaattcagacaacacacatggatccccttaaaacatgtaaatgtgtcagaacacggttgacctgccgccttcttgaacctggtggcccccgttggaactatcagtggcgtctcccatgcacacgccctctgctttctctttcctagactcgcggtgctcacatccagacattaccttgttggtagcccccaagtggcgtgcagtgacaccagtatcttctctgttgcatttttgcaatcttgtgtcccgctcggtgatgttctacaaactctgttttaaggttgagaaagtttcaagggtgaagatctcaaaacagtgctaaaatcaaaggtgtttgctgtgaagaaaaacatgtgtatatattgcaccttgagttgtcagaaggtagaaactgaaataaactaactttaaaaaaaaaa

SEQ ID NO: 145837 - DNA, 6616 bp, Homo sapiens
  Payload ID: 8918
  Gene Symbol: KIAA0556
  Gene Name: KIAA0556
  Uniprot ID: O60303
  ENST ID: ENST00000261588
  CDS Start-End: 20-4876
ggaaccgccgcctctagggatggacggtcagactctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccgggccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaata

SEQ ID NO: 145838 - DNA, 746 bp, Homo sapiens
  Payload ID: 8918
  Gene Symbol: KIAA0556
  Gene Name: KIAA0556
  ENST ID: ENST00000568258
  CDS Start-End: 1-746
ctctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagac

SEQ ID NO: 145839 - DNA, 767 bp, Homo sapiens
  Payload ID: 8918
  Gene Symbol: KIAA0556
  Gene Name: KIAA0556
  ENST ID: ENST00000565672
  CDS Start-End: 1-167
agagaagctggtcctgctcacgagagaaaaaggaggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagac

SEQ ID NO: 145840 - DNA, 392 bp, Homo sapiens
  Payload ID: 8918
  Gene Symbol: KIAA0556
  Gene Name: KIAA0556
  ENST ID: ENST00000618117
  CDS Start-End: 1-333
gagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccaggtctggagactgtggccccagcccacgctttagaatacagagtgtgggtggctgtgggaatagaaatacaatcagagcatttaaaaccccca

SEQ ID NO: 145841 - DNA, 4807 bp, Homo sapiens
  Payload ID: 8919
  Gene Symbol: KIAA0586
  Gene Name: KIAA0586
  Uniprot ID: Q9BVV6
  ENST ID: ENST00000261244
  CDS Start-End: 276-4694
ggttattgttgctcctgtggccattctcttgtcatccccactttcacattttggcgtggtgtattaatagactgagtgggattaatgggtaaatatgactttatagtcagctctaatcctggattcaatatcagaatttagattttcagctttgtggatgttcgacattttaaaaacagttattgcaaagaggtgaaaattttgttctgaagtcttaaggaaacagagaaagtttttccgtccttaagtgtgggacttgttttgtgaccaacaatatgaaaggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaa

SEQ ID NO: 145842 - DNA, 5226 bp, Homo sapiens
  Payload ID: 8919
  Gene Symbol: KIAA0586
  Gene Name: KIAA0586
  Uniprot ID: Q9BVV6
  ENST ID: ENST00000354386
  CDS Start-End: 245-5179
aatttacctaatcccacgtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttggtgtgggacttgttttgtgaccaacaatatgaaaggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaatgtctcactttgtctcacaggctggagtgatcacagtggggtgatcacaactcactgcagtctctacctcctcaggctcatgagatcctcccacctcagcctcccgagtagctgggactacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtttgggggtacatgtgaagaaggtttcctgtataggtaaactcgggctgtggaggtttgtcatacagattatttcatcacccaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttt

SEQ ID NO: 145843 - DNA, 5339 bp, Homo sapiens
  Payload ID: 8919
  Gene Symbol: KIAA0586
  Gene Name: KIAA0586
  Uniprot ID: Q9BVV6
  ENST ID: ENST00000423743
  CDS Start-End: 259-4773
acagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaatgtctcactttgtctcacaggctggagtgatcacagtggggtgatcacaactcactgcagtctctacctcctcaggctcatgagatcctcccacctcagcctcccgagtagctgggactacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggagg

SEQ ID NO: 145844 - DNA, 846 bp, Homo sapiens
  Payload ID: 8919
  Gene Symbol: KIAA0586
  Gene Name: KIAA0586
  ENST ID: ENST00000555833
  CDS Start-End: 143-846
agattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaaca

SEQ ID NO: 145845 - DNA, 814 bp, Homo sapiens
  Payload ID: 8919
  Gene Symbol: KIAA0586
  Gene Name: KIAA0586
  ENST ID: ENST00000555397
  CDS Start-End: 1-627
agcttatccagcactctgcatgatgccgttgaaatggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtca

SEQ ID NO: 145846 - DNA, 582 bp, Homo sapiens
  Payload ID: 8919
  Gene Symbol: KIAA0586
  Gene Name: KIAA0586
  ENST ID: ENST00000554463
  CDS Start-End: 187-582
agattacacccacgacggtgcgggtctcgggcgttctggagatacgtaggggtgaatttatgtttccgacgattgcatctggaggggtgtgtaagactctgtggctgaagaaagctattacgcttcttatgttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagact

SEQ ID NO: 145847 - DNA, 5912 bp, Homo sapiens
  Payload ID: 8919
  Gene Symbol: KIAA0586
  Gene Name: KIAA0586
  Uniprot ID: Q9BVV6
  ENST ID: ENST00000556134
  CDS Start-End: 502-5016
aatttacctaatcccacgtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaatgtctcactttgtctcacaggctggagtgatcacagtggggtgatcacaactcactgcagtctctacctcctcaggctcatgagatcctcccacctcagcctcccgagtagctgggactacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacctgtgaaacatgtaactctattaccttttgcaacataaatacataaaattaaaggaaaataaaaagcattgcttcgtaatcag

SEQ ID NO: 145848 - DNA, 684 bp, Homo sapiens
  Payload ID: 8919
  Gene Symbol: KIAA0586
  Gene Name: KIAA0586
  ENST ID: ENST00000555203
  CDS Start-End: 187-456
gaagggaagtgggtgttgacctgcgggcaactgacgctgttgtcagattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagacagggtttgccatgttgcccagctggtcttgaactcctgggctcaagcagtcttcctgcctcagcctcccacagtgctaggattacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacct

SEQ ID NO: 145849 - DNA, 8233 bp, Homo sapiens
  Payload ID: 8919
  Gene Symbol: KIAA0586
  Gene Name: KIAA0586
  Uniprot ID: Q9BVV6
  ENST ID: ENST00000619416
  CDS Start-End: 275-4876
gtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacctgtgaaacatgtaactctattaccttttgcaacataaatacataaaattaaaggaaaataaaaagcattgcttcgtaatcagatacatgtaggttctaatcccaattctgtaacttcttgctttgtgataggggccaacgaaacgccttcttatcagctgtttcagattaatgggtttaatacttatttttgcagaataatggacatcagtgattgtgtgtggagatgggggtgggtagtgcccagcacagtgcttgataccatgtaagtgctcaataaatggtgttgttcttattatcttgagggatttcagtactgtatagtagagggcataagcacatgaaaagaaaggcagcctagcactagtgaaaaaaatttacctcccagaaaaatcattttctgtcacaactgaatttcaaacacacagtaattacagtcatccttgactttttcagcatttttgtaggttgctaagtggatctcagcactggcagcacattagaacctctgggagctttaaaaaatactaatgcctgggccttgtaccaagggatttcaatttaattgatcttggatggggtccagcattggtattaaaaaaaaaaaaagaccttttcaggtaattttaatgggcactcaaggctgagaattactgaagagcaatttagaattccttaaacttctagtaggagccattgcctggggattttttttctcactgaacatagaagctgcaagagtctatggaaactcagaaatgtgtcagccttccacatgcacttcctcacagcttctctcaggtatttggttactggaatgttttaggtttcactttagaacccgttttctttgatatggccctttggacagttctgcttataacagtttcctttaaacaagtggaagaaaaattctgctctgtggattttaatttgtttttgatattcatctacaagactctgggcaaggtgaaagctggagaaatgttgcttagtgctgcttcattttaaacatgacaccccaccccccaaccttggtttctggttttcatagttttttctgccttggaaggatttcagcaaaatcttgttttagttaaagcattttttatttaaaggtgttggtagatttttcctcctaaccatagaaagcctgccttttctaactttagggtagaagtgtaatctttgatttattctactccctgtgcacgtgagcttttcttttaaaaaaaattagtgtccattcgacggtttcttttttttttttttgagatggaattttgctcgttgcccaggctggagtgcaatggcacaatcttggctcaccgcaacctctgcctcctggtttcaagcgattctcctgccttagcctccttagtagctgggattacaggcgtgcgccaccatgcccggcaaattttgtatttttagtagagatggggtttctccgtgttggtcaggctagtcctgaactcccgacctcaggtgatctgcctgcctcagcctcccaaagtgctgggattacaggcgtgagccaccgcgcccggcattcatctagtattttgttttataggattatttctgttcatggttactcctgtacacattcctctgccaaccacttcagattcttttggaataagacgatgtacgtaaaaacaaactaaatggaacttttgattttataagctttaaaatttttattttatattaaattttacaatttccaacttccggaataaactatttatgagacatgctattaagagactatcaagatcaaggctgttactattgctgggctgtgactggacacggtggctcatgcctgtaatcccaagactttgggaggccgagggtggatcacttgagctcaggagtttgagaccagcctgggcaacatggcaaaacccatctctaccaaaaatacaaaaaattagctggtcatggttgcacacacctgtagccccagctactcaagagggtgaggtgagaggatcgcttgagcccaggatgtcaagactgcagtgagccgtggttgtgccactgcactccagcctgggtgacagaatgagaccgtgtctcaaaaaaaaaaaaaaaaaaattgctgagctatcatgccttaacactaggtaacgtgtttaaaatgttcctttctgctgggtgcgggtggctcacacctgtaatcccagcactttgggaggctgaggcaggcagatcacccaaggttaggagttcaagaccagtctggccaacatggtgaaaccccatctctactaaaaatacaaaaattagccaggcatggtggcgtgtgcctgtaatcccagctacttgggaggctgaggcaggagaattgcttcaacccaggaggcagaggtggcaacgagctgagactgcaccacttaactccagcctgggcaacagagtaagactctgtctcaaaaataaataaataaataaataaaatgttcctctgttttaaatcctaaattcgttctttgtatactttaatagaatcttgaataaatatttttattctta

SEQ ID NO: 145850 - DNA, 5597 bp, Homo sapiens
  Payload ID: 8919
  Gene Symbol: KIAA0586
  Gene Name: KIAA0586
  ENST ID: ENST00000619722
  CDS Start-End: 310-4701
aatttacctaatcccacgtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacctgtgaaacatgtaactctattaccttttgcaacataaatacataaaattaaaggaaaataaaaagcattgcttcgtaatcag

SEQ ID NO: 145851 - DNA, 4859 bp, Homo sapiens
  Payload ID: 8920
  Gene Symbol: KIAA0753
  Gene Name: KIAA0753
  Uniprot ID: Q2KHM9
  ENST ID: ENST00000361413
  CDS Start-End: 360-3263
aatccatccgcatggctttttgctctagttcctcagatctttctgcgctagctgcactcccaagcccaggcttagatctaccctaatctagtcccagccccgacctcatggacactggctgcaaaacttaccgccttgcaacacctggatccttaaatagttcagggcctcaaaggctcccaagccgccctgcgcctgttgctatggcgactgggcaggcggccggaagcgcggccttgttgggggcccccgttgcccgcctcccagtagccgcgcctcaccctaggccaggaatggttttagggaagactgttgccggatgacaaggctgtcactattgttctgtactacctgacattatgggaccaggccagccagcttcaacctgtgttcatctagcacctaggacccaacttgatgggaggagcgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagatagactagaagaagctttggatccagatgaagaacgtcgaatccgtatcaggagacaggagcaagctgctcgctctgcccgaatgctctacgtcctccagcagcaggtaaaagaaatccaggaagaattggataaattgagtccacataaaattaaacacactaagaagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccatttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgccgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacagggtgtttaacctggggagttaaatgtgtacacttgaattaataggagcaccggttgttgctagtataaagtaatttgtgtggcagtttgtactgtgctgagtttttaaaataaacccaatattttaaagtatgtgcctattttaaataacttacatctcctttttttcccacaggcaaagtgaaatgtgatttacagaaaccactgagaatacttttatatgtgatatgactatagtggattatttgccaccccttccccccgagaaaaaaattagtgacaataaaagctaacatttattgagca

SEQ ID NO: 145852 - DNA, 1572 bp, Homo sapiens
  Payload ID: 8920
  Gene Symbol: KIAA0753
  Gene Name: KIAA0753
  ENST ID: ENST00000542826
  CDS Start-End: 1-137
aaaaggccttggagagatggccaagtacatcaccaaagggtgagaggaggcccctcacagcaaaggacacattcccacaggaaacaagtcgaccttctgtagcaaagcagcttcttgccgggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccatttgtgtcacactggagaagggatggcaccaccctttgttttggcccacaggaaattttcatcctcagctgt

SEQ ID NO: 145853 - DNA, 815 bp, Homo sapiens
  Payload ID: 8920
  Gene Symbol: KIAA0753
  Gene Name: KIAA0753
  ENST ID: ENST00000573033
  CDS Start-End: 600-815
cccttggcacctagaagcagccaggagggaagtactgaccatttaaaagtggcagatctccgggccccatttctgcagccttcattctgcaactccagccacccacctgtgccaacgtcaagccagttgggattgccttgctcatgtgcctcctcccatctgcttttttcatgtgtgctacagccttagaaataaggactcttagacagctgtctttatgttcccaagaagtatctgtctttaagcaaatctagtctgcaaattttggatttattcaaaagcttaaattagggttttttttaaaaaaaccttgaatttcccaattgatttactgtaggattttttgagagaacaaattccccagagatttaaaactagtcagttcacagaaaatcagcttaactcaacaaatgctaaattgtgtactatgctcagagcactttgtaatgggaaatagaagagcaagacaaggcccttcccctcaagtcgccttgtctggctgggaagatgagacatgtacatgtgaaataggaatggttttagggaagactgttgccggatgacaaggctgtcactattgttctgtactacctgacattatgggaccaggccagccagcttcaacctgtgttcatctagcacctaggacccaacttgatgggaggagcgaccccaaagtacttcagacccagaaccagctgcagtttaataggaatgttcctacacattcaagcaacttggcgatccgatattcttgcccacatgccattagaattgaaaaactgaagcactcatacaatgaatcataccattgt

SEQ ID NO: 145854 - DNA, 590 bp, Homo sapiens
  Payload ID: 8920
  Gene Symbol: KIAA0753
  Gene Name: KIAA0753
  ENST ID: ENST00000571642
  CDS Start-End: 329-590
agtagccgcgcctcaccctaggccaggtttacttagagtcattgagagttatatgccttcgggccacctgacagagtgaagcatactgctttctgactagtattaagacttgttaatgtagactgcttgtccaaaaaccaccctgctggaacatgctagtttaccatggcaaagctctgttttgggaataacgccttgctggagacctttgagatttgaaatttggaatggaaagggctcaagagattattattaaaatagaatggttttagggaagactgttgccggatgacaaggctgtcactattgttctgtactacctgacattatgggaccaggccagccagcttcaacctgtgttcatctagcacctaggacccaacttgatgggaggagcgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgttt

SEQ ID NO: 145855 - DNA, 851 bp, Homo sapiens
  Payload ID: 8920
  Gene Symbol: KIAA0753
  Gene Name: KIAA0753
  ENST ID: ENST00000572235
  CDS Start-End: 1-210
cttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagttcttattctacactgctgccgtagagattgctctaaaacatgaatcttaccatgtcagacctctgcttaaaagactttagtggctctctgtaacttagaggatgaaagctaaactcttcagcgtggcatgtaagacttcacgatccggcccgcctacatttccagagtcacctccaccttcactccttcatgctaaattcctattacactggggacgaagggatggaaggtgaacactgcctattcactatcttgaactggaaaccagtaactgttttttgggtgcatgaatgaagagcctttttttcattttcaagtgacttgaattaataatggttatatttggacaagaggagatatatcgatgcatccttttctacaaaaaagatcaatggaaagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcgg

SEQ ID NO: 145856 - DNA, 3263 bp, Homo sapiens
  Payload ID: 8920
  Gene Symbol: KIAA0753
  Gene Name: KIAA0753
  Uniprot ID: Q2KHM9
  ENST ID: ENST00000572370
  CDS Start-End: 899-2905
aggcggccggaagcgcggccttgttgggggcccccgttgcccgcctcccagtagccgcgcctcaccctaggccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagatagactagaagaagctttggatccagatgaagaacgtcgaatccgtatcaggagacaggagcaagctgctcgctctgcccgaatgctctacgtcctccagcagcagtgacttgaattaataatggttatatttggacaagaggagatatatcgatgcatccttttctacaaaaaagatcaatggaaagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccatttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacac

SEQ ID NO: 145857 - DNA, 508 bp, Homo sapiens
  Payload ID: 8920
  Gene Symbol: KIAA0753
  Gene Name: KIAA0753
  ENST ID: ENST00000576281
  CDS Start-End: 1-390
cgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaaggcaaagtgaaatgtgatttacagaaaccactgagaatacttttatatgtgatatgactatagtggattatttgccaccccttccccccgagaaaaaaattagtgacaataaaagctaacatttattgagcacct

SEQ ID NO: 145858 - DNA, 3403 bp, Homo sapiens
  Payload ID: 8920
  Gene Symbol: KIAA0753
  Gene Name: KIAA0753
  ENST ID: ENST00000570790
  CDS Start-End: 71-817
aggaatggttttagggaagactgttgccggatgacaaggctgtcactattgttctgtactacctgacattatgggaccaggccagccagcttcaacctgtgttcatctagcacctaggacccaacttgatgggaggagcgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaaggtaaaagaaatccaggaagaattggataaattgagtccacataaaattaaacacactaagaagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccatttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctct

SEQ ID NO: 145859 - DNA, 2262 bp, Homo sapiens
  Payload ID: 8921
  Gene Symbol: KIAA0825
  Gene Name: KIAA0825
  Uniprot ID: Q8IV33
  ENST ID: ENST00000329378
  CDS Start-End: 251-1225
ctccggagccgtcgccagggtggtaatacctggtgcagagcttgagtctggccagcgggtcaggctcttgctagatcagcaccggaggtggaagactggtacattttacatactttgggaaaaaaaaacgttgctgaagttactagaaaagagacagttcttctgctgacaactcttcaggaaataattttctacctccttaggattcgaagaccagttcattcttagtgtcttctgaaataaaattagaatggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactgcaagatttgttgaagaatgaacaaaatcaagaagaaatgacattggatttactttgggacctctcctgccacagcagcgtttcattcccatcaaccctaagtggaacatctttccatttcctctctaggacgtctcttcattctgttgaagataattcctctatggatgtcaagtctatgtgggatgatataagactgcatcttcgacgcttcttagtgagcaaattacaaagccataatgaaataaacaattcacagcaaaaaattttattgaaaaagcagtgcttacaacaactcttgtttctttatccagaatcagaagttataatcaaataccaaaacatacagaataaactgttggctaatcttctgtggaactgctttccttcttacaacagagattcaaatttagatgtaatagctcatggatatcaaagtacaatgcttaagttatactcagtaataaaagaggattttaacacactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttgggttagtgacatttaaaatttttgtttggtttaacttaagtcttttaatatgtttaattttctaagatgttttctatttggttaaatctcactgcaaacatgaaaattagaaaatgaatgtaatgaaattttgcagtatacatttctcatgcatttttttctataattgtagttataaaagtattttctttcttattaaattgttaaagatattggaaatataagccaaaaatactttaaataagagtttaatttctcttgattgcatatgacaaacagtatttgtgaaactgtgtgtatacacacatatatataaatgagtatatatgcttatacacatataagctcctttatctgtttattaaatatacgcatatatataagcacatatactcagttatatatatgtacatttagttatatacataacagaaaagtatgatttttaatccattgtatcttccaaagctaaagcattattaggtaaaaagaatttttgaaaatttgttgaaatttgcagtaaaattggatatttaaaagttgtaatattttagtcagtcaattctaataatgagcaactatgaaatactataattataaaattctgtattgtagttgattaggaaggtataacattttactatagctatttttaaagtttctctactattttttctataaggatgtatacaaataaaagatgatttgaaaatttctattttattcataagataaaggaaaaaaggaaagaagttattgtgatataataaacttttcttattgtggttgtactttcctaccagtggagaaaaatcagggtaaaaataggattatttctaaaattatcattagttatgcttttatataaaatctgaggtgtatttctgaataagttcataaactatatggcttaagtatttgaaaattattatttggtgaattatggatctttgaatttatgatcatctttttaaaattcctatagctcactatacttgtgcgtatcttcattaataaaatttcagttgaccaaattaatgtga

SEQ ID NO: 145860 - DNA, 3968 bp, Homo sapiens
  Payload ID: 8921
  Gene Symbol: KIAA0825
  Gene Name: KIAA0825
  ENST ID: ENST00000427991
  CDS Start-End: 258-3968
agtgacgctccggagccgtcgccagggtggtaatacctggtgcagagcttgagtctggccagcgggtcaggctcttgctagatcagcaccggaggtggaagactggtacattttacatactttgggaaaaaaaaacgttgctgaagttactagaaaagagacagttcttctgctgacaactcttcaggaaataattttctacctccttaggattcgaagaccagttcattcttagtgtcttctgaaataaaattagaatggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactgcaagatttgttgaagaatgaacaaaatcaagaagaaatgacattggatttactttgggacctctcctgccacagcagcgtttcattcccatcaaccctaagtggaacatctttccatttcctctctaggacgtctcttcattctgttgaagataattcctctatggatgtcaagtctatgtgggatgatataagactgcatcttcgacgcttcttagtgagcaaattacaaagccataatgaaataaacaattcacagcaaaaaattttattgaaaaagcagtgcttacaacaactcttgtttctttatccagaatcagaagttataatcaaataccaaaacatacagaataaactgttggctaatcttctgtggaactgctttccttcttacaacagagattcaaatttagatgtaatagctcatggatatcaaagtacaatgcttaagttatactcagtaataaaagaggattttaacacactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttggttactactgaatgcccacagaaaggaagaaacttctctctccctttagacaaagtcgaattcttatcgcagctcataaaatcctttatgaaactggaaaaaggtgttcaagaattgtttgacgaaatacttttatcactcaagataaccagggatacttcaggaattttggagaaatccgatagagaggttgtaatggaaaaacctagagcaaacgaaaccaatattccttccgagcaatcactaccaggaaaagaggctaccttactagattttggctggagaagtgcatttaaagaagtgtctcttcccatggcgcactgcgtagtaactgcaattgaaggtttttccacaaaaattctccaacaggaacagaatgaaaggtcttcagctgtgagctatgctatgaaccttgtaaatgtccagcaagtttggcaagacagccatatgtttcctgaggaggaacaaccaaagaaaattggaaaattttgttctgacatcatggaaaaacttgacacaatgcttccactggctctggcatgcagagatgattcttttcaggaaattagagcaaacttggtggaggcctgttgtaaagtggcaacagctgtcctgcagagactgcaagagagagccaaggaggttccttccaaagcacccctgaaaaacttgcacacatacctctccacagcggtgtatgtcttccagcatttcaagcgatatgataatttgatgaaggaaatgactaaaaaacccatattcctggtgcttgtccaacgatatcaggaattcatcaacactctacagtttcaggttacgaactactgcgtcagagtttgtgctacaagcattttacaggatgctgagagccaccactgggatgactacaaagctttttatgagggggaaagatgttccttctcgatccagatgtggcattatttctgctggtctcttcattacgatctctggaccattctgcctcctaagttagcccaggagattctagtggaagtgctggagaaatctttgagtctactggcctccagatacgctcgggcccaccccagccgtaaaagaactccacagttaagacttgatgtcacaacaattttgatatgcactgagaacatgttatggtcagtttgtacatctgtacagaaacttttgaatcctcatcagcatacagatgataaaatttttaaaattcacactcattgtaataatctgtttacaacattagtcattttgacttcaccattaacagaattatataagacttttcagcatggcctggatgagtctgcttcagattccttaaaatcattttttaagcaaccattatattgggtttcttgcatatcacatttctacccttctttactcaggactccatcagctggaggactgaaagccgagggtcagttgaaactgctcttatcccagccacgttgtaactggaacttgcttctggaaaccctactgcatcatgatggacttttactgagaatcttgctgaagagctcaaaacaagtttccgacacagaaaataacctgaaccaaggacccagcttgatggaagccatctttaaaatattgtaccattgcagtttttctccacaaacatttgcaaacgtttttgtgagctacatggaagaagagcaattatgggactttttatataacatcccagtctcaacgtgcgtggagtacgagctagaggtcatccgatgcttgagactggcactgaccgatgccatcaaggacactgtacagcagatagtatctgtaatgagttctaggagaaactgtgagacaaacctaaacaagcacattgttcctgattgtttgcttgagagcatgccaaaggaatggaattatagtccaaaagaaactaacaggaaagaatcatgcaaaagcttcacaaggcttactgctcaggcagtatctattgtaatcagcaagttacctacggtgattgcatgtttgcctcccccagttaaatacttcttttttctgtctgagagaaaaatgtcaaaaaaatttgttgaattgaagaaagctggcctgcttgtctggaacttgattgtaattatatgtcggatatttgaggacggaaacactgtggaacttttaacaggtgcctctcttgacagatggagtaaagaaaaattgggtttaatttgtatgtgtttgaaaagcatcatgggagaccagacaagtatccataatcaaatgatccaaaaggtcatacagagcattgagcagcagaagcccaactggattgaacgtcaattgttgaaagcaaggaaactgagcactgaatgtgcatttatgacaatagagaaaagcacggccttacaagaaggagatgttgctcttgaactgactgagcagaaaataaacacgatggtcctggatctctgccacaaaccaggtggcagggagtacctgaggcaaatttatcacatcatgcagctcaatgaggaatatttaaaagaacagctgttttctatgaatagttcagaggaaaagccattacccatccgacctttaaagacgaccttgaggagtatagaagatcagccttctgcctttaaccctttccatgtgtataaggcgtttagtgaaaacatgctagatcaggtatccatcacaaaatggaactggaattgggcaaagttgctgccaaattatctgagactggataagatgaccttcagtgtgctgctcaaaaacagg

SEQ ID NO: 145861 - DNA, 4942 bp, Homo sapiens
  Payload ID: 8921
  Gene Symbol: KIAA0825
  Gene Name: KIAA0825
  ENST ID: ENST00000513200
  CDS Start-End: 74-3901
tacctggtgcagagcttgagtctggccagcgggtcaggctcttgctagatcagcaccggaggtggaagactgaatggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactgcaagatttgttgaagaatgaacaaaatcaagaagaaatgacattggatttactttgggacctctcctgccacagcagcgtttcattcccatcaaccctaagtggaacatctttccatttcctctctaggacgtctcttcattctgttgaagataattcctctatggatgtcaagtctatgtgggatgatataagactgcatcttcgacgcttcttagtgagcaaattacaaagccataatgaaataaacaattcacagcaaaaaattttattgaaaaagcagtgcttacaacaactcttgtttctttatccagaatcagaagttataatcaaataccaaaacatacagaataaactgttggctaatcttctgtggaactgctttccttcttacaacagagattcaaatttagatgtaatagctcatggatatcaaagtacaatgcttaagttatactcagtaataaaagaggattttaacacactatgtgaaattttagctccatcttcaatggtgaaattcattaaagaaacttacctggatactgttacagaagaaatggcaaaatttcttgaaaatttttgtgagctgcagttcagagaaaatgctgttcgtgtggttaaaacaagcaagagctccagcaagcatagaggagcagtgcatgctttggttactactgaatgcccacagaaaggaagaaacttctctctccctttagacaaagtcgaattcttatcgcagctcataaaatcctttatgaaactggaaaaaggtgttcaagaattgtttgacgaaatacttttatcactcaagataaccagggatacttcaggaattttggagaaatccgatagagaggttgtaatggaaaaacctagagcaaacgaaaccaatattccttccgagcaatcactaccaggaaaagaggctaccttactagattttggctggagaagtgcatttaaagaagtgtctcttcccatggcgcactgcgtagtaactgcaattgaaggtttttccacaaaaattctccaacaggaacagaatgaaaggtcttcagctgtgagctatgctatgaaccttgtaaatgtccagcaagtttggcaagacagccatatgtttcctgaggaggaacaaccaaagaaaattggaaaattttgttctgacatcatggaaaaacttgacacaatgcttccactggctctggcatgcagagatgattcttttcaggaaattagagcaaacttggtggaggcctgttgtaaagtggcaacagctgtcctgcagagactgcaagagagagccaaggaggttccttccaaagcacccctgaaaaacttgcacacatacctctccacagcggtgtatgtcttccagcatttcaagcgatatgataatttgatgaaggaaatgactaaaaaacccatattcctggtgcttgtccaacgatatcaggaattcatcaacactctacagtttcaggttacgaactactgcgtcagagtttgtgctacaagcattttacaggatgctgagagccaccactgggatgactacaaagctttttatgagggggaaagatgttccttctcgatccagatgtggcattatttctgctggtctcttcattacgatctctggaccattctgcctcctaagttagcccaggagattctagtggaagtgctggagaaatctttgagtctactggcctccagatacgctcgggcccaccccagccgtaaaagaactccacagttaagacttgatgtcacaacaattttgatatgcactgagaacatgttatggtcagtttgtacatctgtacagaaacttttgaatcctcatcagcatacagatgataaaatttttaaaattcacactcattgtaataatctgtttacaacattagtcattttgacttcaccattaacagaattatataagacttttcagcatggcctggatgagtctgcttcagattccttaaaatcattttttaagcaaccattatattgggtttcttgcatatcacatttctacccttctttactcaggactccatcagctggaggactgaaagccgagggtcagttgaaactgctcttatcccagccacgttgtaactggaacttgcttctggaaaccctactgcatcatgatggacttttactgagaatcttgctgaagagctcaaaacaagtttccgacacagaaaataacctgaaccaaggacccagcttgatggaagccatctttaaaatattgtaccattgcagtttttctccacaaacatttgcaaacgtttttgtgagctacatggaagaagagcaattatgggactttttatataacatcccagtctcaacgtgcgtggagtacgagctagaggtcatccgatgcttgagactggcactgaccgatgccatcaaggacactgtacagcagatagtatctgtaatgagttctaggagaaactgtgagacaaacctaaacaagcacattgttcctgattgtttgcttgagagcatgccaaaggaatggaattatagtccaaaagaaactaacaggaaagaatcatgcaaaagcttcacaaggcttactgctcaggcagtatctattgtaatcagcaagttacctacggtgattgcatgtttgcctcccccagttaaatacttcttttttctgtctgagagaaaaatgtcaaaaaaatttgttgaattgaagaaagctggcctgcttgtctggaacttgattgtaattatatgtcggatatttgaggacggaaacactgtggaacttttaacaggtgcctctcttgacagatggagtaaagaaaaattgggtttaatttgtatgtgtttgaaaagcatcatgggagaccagacaagtatccataatcaaatgatccaaaaggtcatacagagcattgagcagcagaagcccaactggattgaacgtcaattgttgaaagcaaggaaactgagcactgaatgtgcatttatgacaatagagaaaagcacggccttacaagaaggagatgttgctcttgaactgactgagcagaaaataaacacgatggtcctggatctctgccacaaaccaggtggcagggagtacctgaggcaaatttatcacatcatgcagctcaatgaggaatatttaaaagaacagctgttttctatgaatagttcagaggaaaagccattacccatccgacctttaaagacgaccttgaggagtatagaagatcagccttctgcctttaaccctttccatgtgtataaggcgtttagtgaaaacatgctagatcagtcagccatcacaaaatggaactggaattgggcaaagttgctgccaaattatctgagactggataagatgaccttcagtgtgctgctcaaaaacaggtgggaaatgaagaaggatgaaacactagaagaggaagaaaaagcaatactggagcacttaaaacaaatttgcaccccacagaactcttctgcctcagataacatagaggaacagtaatctgcagaaaacagcaacagctttattttaggaaacaatcccatgtaatggagtaggattttttaccatagtcagaatgaacctcatatgtgctgtgaagcatgaaaccaatgactgagtaatctctgtactgaaaaggaatacagcacataaaggataaggtgctacatatttttttattttaaaaataatttcaaatgtttttctttccccaatctttctctttatatgatataactgctgccatctcgtgttccctttgaattatttttttctcctttcagtcttgaagtatctatgacaacaggaagaaatgttcagaaattttttaaaggattttttaaatacaacatttggatgttaagttgagtggagtcacatagccccaggaggtcatctgaaatttttaatttaattttgttgtagctgtagcccaagtcccaattttaattgcctttactatccacaattgtgtcaactttcctcattcaatttatctaattatagtcaaaaaaaagcattctcctgaactataactttagtcacacctctgcttgtagtggttttcagtcttcctcctaaaccagaatcaaatttctactcatacatattcaggtcctataccaaatggctccatgttcagacaattgcttgccatcctcttggttcaagtcacatgcttgccatgttttcccaatcagaatccatctttcttccaaaattaggctcaaaactaattccagcaatctttaccccaaagctcattagctcatataatgtgttactttaaaattttttcattgtattgatacacacacacaaaataagaaaacagaacatgctctagtaccctctctgccaaggacaattatagatatttattatttccttcctatcactgcctgatattagattataaagacattgaagatattatgatataatatgaagtctccctttataactccctgtatgcctactacagtgttatttcatcaagtggacagttaacgaacacaattgattaaatagctgccaatg

SEQ ID NO: 145862 - DNA, 4153 bp, Homo sapiens
  Payload ID: 8922
  Gene Symbol: KIAA0895
  Gene Name: KIAA0895
  Uniprot ID: Q8NCT3
  ENST ID: ENST00000297063
  CDS Start-End: 52-1614
tcgcccagaggttgacagaggaaggtgggtgggggcctagagcggtgggtcatggctggctgcacccgcaaactcactcacctccgtaaacggatccatcgccccaggcgtcggactacgagacgatggaaacggtggttcaaattcaggaagagaaaaggagagaaaaggccaagacctaatcataaggcagtggcaagaagagctaaactcaagttctctacctcagaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctcaga

SEQ ID NO: 145863 - DNA, 4241 bp, Homo sapiens
  Payload ID: 8922
  Gene Symbol: KIAA0895
  Gene Name: KIAA0895
  Uniprot ID: Q8NCT3
  ENST ID: ENST00000317020
  CDS Start-End: 302-1711
agtttcctagcaaccggcggagcggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaag

SEQ ID NO: 145864 - DNA, 4132 bp, Homo sapiens
  Payload ID: 8922
  Gene Symbol: KIAA0895
  Gene Name: KIAA0895
  Uniprot ID: Q8NCT3
  ENST ID: ENST00000338533
  CDS Start-End: 72-1595
gagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctca

SEQ ID NO: 145865 - DNA, 1952 bp, Homo sapiens
  Payload ID: 8922
  Gene Symbol: KIAA0895
  Gene Name: KIAA0895
  Uniprot ID: Q8NCT3
  ENST ID: ENST00000436884
  CDS Start-End: 435-1688
aagcgcagcgcgcgcggaccccgggggcagtttcctagcaaccggcggagcggctacgtcacggtggcaggttctaagcgctgctgggcaccgtaaggccgccgtgtgtaccttccagtagctacgggctggtggaagcgctgctcacagtcagtgtcgaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttg

SEQ ID NO: 145866 - DNA, 956 bp, Homo sapiens
  Payload ID: 8922
  Gene Symbol: KIAA0895
  Gene Name: KIAA0895
  ENST ID: ENST00000453212
  CDS Start-End: 74-901
ccgccgtgtgtaccttccagtagctacgggctggtggaagcgctgctcacagtcagtgtcgtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagtt

SEQ ID NO: 145867 - DNA, 437 bp, Homo sapiens
  Payload ID: 8922
  Gene Symbol: KIAA0895
  Gene Name: KIAA0895
  ENST ID: ENST00000429651
  CDS Start-End: 13-437
gagcggtgggtcatggctggctgcacccgcaaactcactcacctccgtaaacggatccatcgccccaggcgtcggactacgagacgatggaaacggtggttcaaattcaggaagagaaaaggagagaaaaggccaagacctaatcataaggcagtggcaagaagagctaaactcaagttctctacctcagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgt

SEQ ID NO: 145868 - DNA, 2441 bp, Homo sapiens
  Payload ID: 8922
  Gene Symbol: KIAA0895
  Gene Name: KIAA0895
  Uniprot ID: Q8NCT3
  ENST ID: ENST00000440378
  CDS Start-End: 262-1815
aggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgt

SEQ ID NO: 145869 - DNA, 603 bp, Homo sapiens
  Payload ID: 8922
  Gene Symbol: KIAA0895
  Gene Name: KIAA0895
  ENST ID: ENST00000431396
  CDS Start-End: 312-603
acgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaaca

SEQ ID NO: 145870 - DNA, 2865 bp, Homo sapiens
  Payload ID: 8922
  Gene Symbol: KIAA0895
  Gene Name: KIAA0895
  Uniprot ID: Q8NCT3
  ENST ID: ENST00000415803
  CDS Start-End: 332-1246
ggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacgggtgagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcaggtaaaatgccatttcaatagtggtagttcatttttatgtactaaaacaattatctgtgatcttataagcaaaaacaaagacatttaaaaatattcaaattatttctatgttatggttaattcccactcaggacatgtaaatgtgcgacaagacgagtattacctgtatataaactccattgcattcatcaaaatttataatctgttatataggctctttgtgacaggaagcaattatattaggaagacagcttcagattctggttctaagctttcatgtgggagttacaaacttgtggccaatttagccgcctacagacaagtgttgggtagcccacactacgtttttgttttctaattgatttctttgttgttttttgtttttttctgagacagattcttgctctttgcccaggttggagtgtagtggcacgatcttggctcactgcaacctctgccttctgggttcaagtgattcttgtgtctcagcctcccgagtagctgggactacaggcacccgccaccatacccagctaatttttgtaattttagtgaagatggggtttcaccattttggccaggctggtcttgaactcctgatctccagtgatttgcccgccttggcctcccaaagtgttgaggttgcaggtgtgagccaccatgcctggcctctaattgattttttaatgtcttagatggagcatgcaatccctggttcttcctattgtgttaaattcctggcttgcttaggctccggtaagtagtttgggaaccgaagcttgattcttgtccatgaacttgttaatgcttcactgaaattgttaatcatcatcaaataaatatttaagcacttattcaaagataaaaataatgggattttcaaaattatcttcaagtttagcaaattatgatgtgaacgttatgaataatacttttaaattgctcactttaagcccttagcagttttgtgttttacagggctataatacatttcagaacctcatttaagcatttgagaagaaattagctaatgtttatctgcagggcatagttttgagatcataaaggccgacaatatttggtcaaattaactttgttcaggtttttataatatattagcttcaacttggcattgtcagtgactgaaaatctgtttgtaggataggtaaaactgcatggttctctcgcctgtggtgcatgtcctattttagcatttttgctgataatagttatttggtcttgcggccagcagatattttgctgtttattatagataacatggaatctggccagtcttttgaagccattatgtaaaacttaattatgtaaagccattatgtaaagattaaaataattttaatcatggtatttactttcctttgttagggtctctttgcttctgcttctgtattctttaatgggtatttgctttttaaaaaatgtgctgagattgtgctaaaaattgtgattcaaattgataacttactaatataaagtggcacttctggatgggagaaggcagcattaacatagtgattacataatccactcttaggctgtactacttccacattgtaaaatggagtaaagaaaatacctactttaggagattattttgataattaaatgagagaatgcttagtgcatatattgcagttatcatcgtgcttggcacctacaaagcactaataaagaggttagctgtta

SEQ ID NO: 145871 - DNA, 3550 bp, Homo sapiens
  Payload ID: 8923
  Gene Symbol: KIAA0895L
  Gene Name: KIAA0895-like
  Uniprot ID: Q68EN5
  ENST ID: ENST00000290881
  CDS Start-End: 928-2343
tggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagatggagaagtaacagcatgtgtttatcctgatggaaagagtccagtagagaggaagagattgatgatgtaggagagaggagaaatgctggaaaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 145872 - DNA, 2233 bp, Homo sapiens
  Payload ID: 8923
  Gene Symbol: KIAA0895L
  Gene Name: KIAA0895-like
  Uniprot ID: Q68EN5
  ENST ID: ENST00000563902
  CDS Start-End: 737-2152
cgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgc

SEQ ID NO: 145873 - DNA, 3500 bp, Homo sapiens
  Payload ID: 8923
  Gene Symbol: KIAA0895L
  Gene Name: KIAA0895-like
  Uniprot ID: Q68EN5
  ENST ID: ENST00000561621
  CDS Start-End: 888-2114
gcgacggctcccgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagatggagaagtaacagcatgtgtttatcctgatggaaagagtccagtagagaggaagagattgatgatgtaggagagaggagaaatgctggaagtgagtcactgagcaggcaagggagctcagcagctggagcctctccagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 145874 - DNA, 1977 bp, Homo sapiens
  Payload ID: 8923
  Gene Symbol: KIAA0895L
  Gene Name: KIAA0895-like
  ENST ID: ENST00000568563
  CDS Start-End: 1-616
ctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 145875 - DNA, 1155 bp, Homo sapiens
  Payload ID: 8924
  Gene Symbol: KIAA0907
  Gene Name: KIAA0907
  Uniprot ID: Q7Z7F0
  ENST ID: ENST00000368319
  CDS Start-End: 1-1155
atgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctag

SEQ ID NO: 145876 - DNA, 4499 bp, Homo sapiens
  Payload ID: 8924
  Gene Symbol: KIAA0907
  Gene Name: KIAA0907
  Uniprot ID: Q7Z7F0
  ENST ID: ENST00000368320
  CDS Start-End: 27-1721
cgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacatggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttctttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 145877 - DNA, 2947 bp, Homo sapiens
  Payload ID: 8924
  Gene Symbol: KIAA0907
  Gene Name: KIAA0907
  Uniprot ID: Q7Z7F0
  ENST ID: ENST00000368321
  CDS Start-End: 25-1869
ggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatgattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattctg

SEQ ID NO: 145878 - DNA, 4299 bp, Homo sapiens
  Payload ID: 8925
  Gene Symbol: KIAA0922
  Gene Name: KIAA0922
  ENST ID: ENST00000240487
  CDS Start-End: 1-4164
ccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 145879 - DNA, 5017 bp, Homo sapiens
  Payload ID: 8925
  Gene Symbol: KIAA0922
  Gene Name: KIAA0922
  Uniprot ID: A2VDJ0
  ENST ID: ENST00000409663
  CDS Start-End: 53-4882
agcgagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 145880 - DNA, 5017 bp, Homo sapiens
  Payload ID: 8925
  Gene Symbol: KIAA0922
  Gene Name: KIAA0922
  Uniprot ID: A2VDJ0
  ENST ID: ENST00000409959
  CDS Start-End: 50-4882
gagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 145881 - DNA, 538 bp, Homo sapiens
  Payload ID: 8925
  Gene Symbol: KIAA0922
  Gene Name: KIAA0922
  ENST ID: ENST00000445960
  CDS Start-End: 51-266
cgagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatg

SEQ ID NO: 145882 - DNA, 2723 bp, Homo sapiens
  Payload ID: 8926
  Gene Symbol: KIAA0930
  Gene Name: KIAA0930
  Uniprot ID: Q6ICG6
  ENST ID: ENST00000251993
  CDS Start-End: 146-1375
gctcccccccagccaagccttcccggcttccagcccagacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 145883 - DNA, 8119 bp, Homo sapiens
  Payload ID: 8926
  Gene Symbol: KIAA0930
  Gene Name: KIAA0930
  Uniprot ID: Q6ICG6
  ENST ID: ENST00000336156
  CDS Start-End: 67-1281
ctccccgccgccgccgcccccgagcctgcgggcggcgccgaggccgaggagcgctcgctgcagcacatgctgcgtgccatagcggaggagcgcggccgtcttagcctgcgccgcgaggtctgcggcctcgggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaaaaaaaaaaaaaaaaaaaaaaaaaaaaagatacattggtctttaaacccaaaccccctttaaggcatgttggtctcaaggggatttgggattgaagcacagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggaccatgtcctaatatggtggttttaagttgttggccaaaatcctttaaagacatacgaaacatctgccaactttttagcgaacttaacaggtttcactgacgttttcctcaatttttgaatttaggtgggatttgctttcatgtcctgtttcaaaaaccaagtgtctcttgacagcccactggttcttcctgtcctcttgctctagtctgtatcagaaagcagaatgactgtacttttgttttacaaacaaccacctgataggacggacactccacgagataaggaaaggcacgtgcccttgagcttgaatggaagcagcctctggagggggcagccactgcccttcgagggagagcagctcttcagcagtggccagagtgccacgtgactctgcagatgacccctgggagccgggtgatgggcacctgctggggcttttgttttttctttttcactggctggcttgatcctcagtggcaaaaggacccctgagccccttctccgagccctggagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaaaaacacgatgctggcctccactggatagctcagtatgctgattgccagtgatagttctgtacgcgttaccaacagcgtctttattaaccctcttccacatccagtggaaatcattgctaggcggtatttgttggttggctgttagctttgctttatgatttcatgtttcttttaaaggttgttttgcatgttgaatattaaattttttttttctgtgtcttcctctaatctttttctgtaatgggaatttcagggtaaatacagatattatagcaaagcaataatttaatgattgaaacttaatttgcccccagtgattcctgaaactttttttggagctttcacacaaactacttttttgaactagagtgtgttggaggcagagaaaaatcaccctgtgtgctggctttgcctgccgtgagccagtgaggagtccgagaagaggtgggcaggtcagtgatgggtttggccagagatgccatatttgcagtattaaatcatttcaagatgcatttcaaggcctggcacggctcacgcctgtaatcccagtgctttgggaggccgaggcgggcagatcacttgaggtcaggagttcgagaccagcctggccaacatatggtgaaacccccatctctactaaaaatacaaaaattaaccgggcgtggtgatgtgcacctgtagtctcagctacttgggaggctgaggcaggagaatcgcttcaacccaggaggcagaggttgcagtgagccaagctcatactactgcgctccagcctgggtgacagagactccatctcaaaaaaaaaaaaaaaaaaaaaaaaaaatgcatttcaagttaagcttttagcctccacaaagtagtgcacaccctttcagttgtactataaaatttcccaggctttttcagagaacctcttaaccctcacagaaatggaaaaaatggaatagaggccaggagccccaagttcaggttttgcaggctccaggtaagctggctgatctaacggaagatgaggtgtttgcagcaggcgtctgtcttgcagctcagcaggtgaggggacctcgagcaggctctcgcattttccggctgatccttccgagtctgctactgcagggccctcgtaggtgggagcagcctcatcgtcgcctttcacactgtgagcttttcctttccacggtcagatggacttagtgagttaccagcgatggatgttaagacctaagacaccgcagaaagttacagagtggaaaatgaggggcagagaaaagagggtctgagaggaacgcaagcattccggaatacagtaagggacatcccatcaatgacacttcttgggaacagccactgccttagaaacaccagaccaagagaattttctgaccacaaccccaaaggcagcccatgaagatggaggttaggaaggaggcggtctagcaggtgaagacttccttgccatccaggtcaacccccttcttgttgaacagtgggaagtccttttaaagcagtcacctgaaaaatgtttaatagaaatttggggagagtctctatcttggaagctgcctgcgggaacctcattcctattcattgcctcctcttggaaggctaatctgctatttcggttcctttagccttagatgagcttttaggaagtactgtcatgccctagcttagaaggaaaaaaggtaactggaaaggaaaacctttgggaatcttacactgggaggagaggggaatgtaactcaatccatataataacacagttcattgtaaatagacatgttgactgtggtaacatgctgtactttgtgcctgattgttaaaatgctaagaacagctggaaaatttacatgaggaagagaaaatacttgtttctggggataaagaaaggatcatgttgtcttttctttccttacagtgtcactgaattgcccctgacttagcctctccatcagccaacaggttagagagttctttcctctgtgtggactggggtctttcctcttggaatctgattttaatgaaacaattaggttgctcattttgaaataaccatggcttttagccaaattttatgctactctgaataaacaattttgcttaaaagattttagccacttccagaa

SEQ ID NO: 145884 - DNA, 2623 bp, Homo sapiens
  Payload ID: 8926
  Gene Symbol: KIAA0930
  Gene Name: KIAA0930
  Uniprot ID: Q6ICG6
  ENST ID: ENST00000391627
  CDS Start-End: 163-1275
catggaggcgggaggaggtggaatgatgactgggcagtggctgggtggcctcaagcccaggcagtggaggaaagggcggggaagctggcagtgctggctcttggctgagatggggcacctttgcggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 145885 - DNA, 625 bp, Homo sapiens
  Payload ID: 8926
  Gene Symbol: KIAA0930
  Gene Name: KIAA0930
  ENST ID: ENST00000424508
  CDS Start-End: 170-625
tttcgttcccccgggtcctgtgagcctgggaggtcttgccagtcccgtgggctctcctggccctcacccctggaggctgacaaggctcgctgacccagaccctcaccgatgaagcctccttctcttttcctccctctcactgccctagagcccaggagccaggcagggcatgggagtggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttc

SEQ ID NO: 145886 - DNA, 516 bp, Homo sapiens
  Payload ID: 8926
  Gene Symbol: KIAA0930
  Gene Name: KIAA0930
  ENST ID: ENST00000417906
  CDS Start-End: 40-294
gcgggcggcgccgaggccgaggagcgctcgctgcagcacatgctgcgtgccatagcggaggagcgcggccgtcttagcctgcgccgcgaggtctgcggcctcggacctcatgcagcgcctggggcagagcaggcccacagaactggatacgaagcccaaccccacgagcttgccaggtgcccggacttgaaggtctcggtttccttaactgtaaaatggctgttaggtggtcacacatgtggcctggggattgtgaaagcacttcgaggatttcacagcgttgtgcaagtctaagacaggcccatgaataaagttctgcctgccagcagctgaggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggt

SEQ ID NO: 145887 - DNA, 2218 bp, Homo sapiens
  Payload ID: 8926
  Gene Symbol: KIAA0930
  Gene Name: KIAA0930
  ENST ID: ENST00000423262
  CDS Start-End: 1-870
ggagaccctgacatcgactgggaggagagcgtctgcctgaatctcatcctgcagaagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttca

SEQ ID NO: 145888 - DNA, 821 bp, Homo sapiens
  Payload ID: 8926
  Gene Symbol: KIAA0930
  Gene Name: KIAA0930
  ENST ID: ENST00000440039
  CDS Start-End: 1-213
ttctggacttggatgttctccacctacttcatggagaaatgggctccccggcaggacgacatgcttttctatgtgcgccggaagctggcgtactccggcagcgaaagcggtgcagacgggaggaagatcccagctctgcctttggggggtgcaggcctgtgcacctgcaagagggcccagcagtgcccagcccctcggagcccgagtcagtgagagcacccaggaccgggaccagaggcccccagtcagcacagctgcttcaaaattgaaagccaggctgggcgcggtggctcacgcctgtaatccctgcactttgggaggccgaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcgaggaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagcgtggccgcccgcatggcacagaagatgtcgtttggcttctacaagtac

SEQ ID NO: 145889 - DNA, 556 bp, Homo sapiens
  Payload ID: 8926
  Gene Symbol: KIAA0930
  Gene Name: KIAA0930
  ENST ID: ENST00000414854
  CDS Start-End: 147-556
agtgcagaggatgctgcgtgcctgccgcgagccggtgcctaacacctgccgcgtttccttcagtcctgctcccggagaggtgggttctgtcttgacctcattctgcagggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaaggcagctgagcctgaggtggaggtggaggtgtaccggcgggactccaagaagctgccaggcctgggagaccctgacatcgactgggaggagagcgtctgcctgaatctcatcctgcagaagctggactacatggtgacctgtgcggtgtgcacacgtgctgacggcggggacattcacatccataagaagaaatctcagcaagtgttcgcgtcccccagtaaacaccccatggacagcaagggggaggagtccaagatcagctaccccaacatcttcttcatgattgacagcttcga

SEQ ID NO: 145890 - DNA, 403 bp, Homo sapiens
  Payload ID: 8926
  Gene Symbol: KIAA0930
  Gene Name: KIAA0930
  ENST ID: ENST00000492273
  CDS Start-End: 75-332
gggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaagatgaggaaacggagggctcggagatgaagtgattcgcctaacgtatttcatccactaaatcgcagtgtgggaggagctaataaaatacattttgcatg

SEQ ID NO: 145891 - DNA, 589 bp, Homo sapiens
  Payload ID: 8926
  Gene Symbol: KIAA0930
  Gene Name: KIAA0930
  ENST ID: ENST00000496226
  CDS Start-End: 248-517
agccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatgggtgggggtcgggagtggtgagggaagggtggcgcatctcagagccctcgcaaatttctggccagaaatgtgggggtatgggcgcagcttggccaaggccatgctgcaagggccagggtggccgtccttcctcactcctgtctggcctccctctgcagggtgcttcaaggatgaccgcatcgtcttctggacttggatgttctccacctacttcatggagaaatgggctccccggcaggacgacatgcttttctatgtgcgccggaagctggcgtactccggcagcgaaagcggtgcagacgggaggaagatgaggaaacggagggctcggagatgaagtgattcgcctaacgtatttcatccactaaatcgcagtgtgggaggagctaataaaatacattttgcatgc

SEQ ID NO: 145892 - DNA, 6732 bp, Homo sapiens
  Payload ID: 8927
  Gene Symbol: KIAA1024
  Gene Name: KIAA1024
  Uniprot ID: Q9UPX6
  ENST ID: ENST00000305428
  CDS Start-End: 76-2826
gccctgcgcccggggcgcctcggagaactgacctgaagtttcagtgtagtcagagagctcttcaagtaataaatcatggagaccagtcaggaaacttccctcttcttggtgaagatcttggaggaactggacagcaagcaaaataccgtttcttatcaggacctgtgcaaatctctctgtgcccggttcgacctgtcgcagcttgccaaactgagaagtgtgctcttctacacagcttgtctcgatcccaattttccagccacgctattcaaagacaagatgaaatgcactgtgaataaccagcaatcaaagaaaatcatggtggcagcagatattgtgacgatattcaacctgatccaaatgaatggcggggctgccaaggagaagctgcccacgggccgccagaaggtacgcaagaaggaggcatcctttgaatcatgtaggtcggacacagagatctgcaatgcagctgagtgtgagcccctgaactgtgagctgagtgagaggtctttcagccggggctaccccatcaggcagtcgtccaagtgccggaagatggactgcaaggactgcccacagtttgtccctgcctctgagcctaacttcctgttgggagttagcaaagaggtgaaaaaccgcgccgcttccctggacaggttgcaggccctggctccgtactctgtgaccagccctcagccctgtgagatgcagaggacctacttccccatgaacatcgaaaacgagtccatttcagaccaggactccctgcccatcaatcagagcatcaaggagaccttcatttccaatgaggagccatttgtggtccagtcctgtgtccagaaaaggaatatcttcaaagaggattttcacaatttgatggcagtgtcccccagtttggttggccccatcagcaaagcagagaatgagcacagggaaccccagagtcgaaaggaaccccacaagccacccttcttcaaccacagctttgaaatgccctataacagccagtacctgaatccagtgtattccccggttcctgacaaaaggcgagcaaagcacgaaagcttagatgaccttcaagcctctacatattttgggcccactcccgtgatgggaacccaagaagccaggcgctgtctagggaagcccaacaagcagactccctggccagccaaaagctggagcctaaacacagaggaagttcctgactttgaacggtcctttttcaatagaaatccctccgaggagaagctacactatccaaatgccagtagccagacccccaatttcccagccccagaaaggcgcccaacttaccttgtgccaaaggatcaacagccaattctccccattgcttatgcggcaaaacaaaatgggctcaaatctaaagagatctcatcccctgttgacctggagaagcatgaaccagtcaaaaagtttaaagacaagagcattaactgcaccagtgggcagctcagctcagacaccagtagcgtgggcacccagactgagcacgtgctggagcccaagaaatgcagagacctgtgcacctctggtcagggcaagtacagtgacaggcacaccatgaagcactcagacgatgactcagaaattgtcagcgacgacatcagtgacattttccgatttcttgatgacatgagcatcagtggctccacgggagtgatacagtcgtcctgctacaacagcacaggatccttgtctcagctccataagtcagactgcgacagttcccctgagcacaacttaaccaaaattgccaatggggtccccaacagcaagggagacaagggcaaccggcctgaaaacacccaccactcggaagaagagctgaagaccagtgtgtgcaaactggtgctcaggattggcgaaattgaacggaagctggaatccctgtcgggtgtccgtgatgaaatctcccaggtcttgggcaaactaaataaattggaccagaaaatgcaacagcctgagaaggtgagtgtgcagatagatctgaactccttgacaagcgagggtccgtctgatgacagtgcctctccccggatgttccacgcacacagtggctcccacggacccaaactagagaacaaccctgactggtgctgctctgatgctagcgggagcaacagtgaaagcctgcgggtcaaggccttaaaaaaaagcctcttcaccaggccatcctctaggtccctaacagaggagaacagtgccacagagtccaaaattgccagcatctccaactcgcccagagactggcgcaccatcacttataccaaccgtgtgggcctcaatgaggaggagataaaagacacaggcccaggagataataaagactggcatcggaaatctaaagaggcagacaggcagtacgacattcccccacagcaccgactgcccaagcagcccaaagatggcttcctggtggagcaggtgttcagccctcacccctaccctgcctccctcaaggcccacatgaagagcaaccccctgtacacagacatgcggctgaccgagttggccgaggtgaagcggggccaaccttcttggaccattgaggagtatgcacggaatgcgggcgacaagggcaagctgacagccctggacctgcagacgcaagaatctttaaacccaaataatttagagtactggatggaagacatttatactccaggatacgattcattactaaaacgtaaagaagccgaattcagacgagccaaggtctgcaagatagctgctctgatcgctgctgcggcatgcaccgtcatcctcgttattgtcgtgcccatctgcacaatgaaatcatgagctaagaatgcaaccttacgtacagcttatgactaccaatgtcgtcgtctgtatcttagaatcttgcagcagtgaggcaacaatttgttgaaatggagatgaaatcatggaggcatttctacaaatgttgaatgaaggtggttttcagaaagtatacattctagtgagaaatctacctacctattagctttgactcaattacactctgacgcatttttagaagtgcaatatcttttcctaccaaaagaacatcatggactatcaataaatacaaattgaatattccaagccaaaaaaggaagattaattgggttctttccattttgatgatgtttcatggtggggaataagttatacagaagatatttaatacacgcctctttagaagaaactaagggaaatagcaacataagaagaaaagaggtggcttctcttttccataatgttcttagaccattgctggtgaagtaacagggtgtgtgtccctaaagggtattacttctctgtcgacttttatcaagggctactgacgtttcattcttgcccttttgtcatcaacacgacagagtgtctgcatcactgcagatcttcatggaaacattctggaccttcttccttgcacttggagtgagaaggagctggactaccaagtcaggcgtggaatgaagtatgctcagactgcatgatgggccaaggtattcaggccaggagacctcgtcctcaatccaaagtgtaggggagctgcctgctaacgatgtaaggtcagtatttgaaaatcatggccactccaaaggatctcctgttcttgctttggtgtgtggctccattccttgattttctatctcctggtggtaccagatgctctgcctctcatacatgagttgaagagtttggaacttgtccttgtgccttgaagagtagagacaatggctaaacgttgacattctatctgtaaaccatggttttcacgcaccactaatatctgccattttcaatggctttaaaaagattttgaaagcttgctcaataatgttcaataatataataataataaaggcactgaggtcttctcagttaccccaacacctactccagagttttgaatacttgtcagcagtgcaaaaaatattatctgtttaaccacttatctatatgtctatctatctatctatatgtctatctatctatctaaatacttgatttttatttattgtcttctctgttaaataacttgagagcaaggtttctttcgtgtaaaagaagctgttgtaatttcatccaaatttgatctgtttccacctgctgaatggtgctctgacaataatggaacagaaagaatccttatcagcatctgattccaatgtcttgttacaggtcaaagaaaaaaggattgacagaaactagctaccttatatatattttttgataataaggtgggatataaatagattttggtagcaagtgtaatcactccgtatgatataataaatttctaaaagatttgagagcatctcaatttttaaagcaataggagtctagcatccattctgaaaaatcgcaaataatgcttagcttgctgtgtctgattctgttgttcaccattaaggggtagacagttaattttattatgttaacaagtgagggatgaatgttttcatctgtggtgaacctttatttttagaagtcttcatgttatctatttgtattatcatgtttatgtatggattttcaatttcagtaaccgaaaacttaagccttagtatgaaaaactgaggatttataattgaaaatgaaaaaaatatgttactctctatcatcagaattatagtctttggtgctctgttttcaatggggcatattacataaggttgtttctttcaccccaaagagactactaggttaccactctgggcattgcctttccacctaacccctcaaccagtaagactctacaccatattgtagccccactattctcctctttatcacagatgaagtgccagagcatcagagataggtagctcccaacctcttgctctggatttgcagaagagggggagatgtacttacccaggataagaaaaatctagtcaaatccaccccaaatcttccatttaacaggtaggaccatcgaggctggaccaaaccactttttccactgcccttggtgaatctattcctagtggaccccatttgggcatgtgcctagctaccttgggaaggcatgactataagtcacacctcaggcttggaaatgaaaggattctatagaatattctatactttccatagctggagaggtagtcagaaattcagtcttgctctgagtccacagtagctttaaaattcaactcaacattgttgtcacgtaacggaaacatctagacctggtaataatccaggaaattgcaaaatggaggccaaaagtaaggtgggtttctctggaaaggggtcatcctcagtctgataataccaagtctgacgctgaggttatgaatcattaccatggcttggagctattggatgcttggggtcttgggatagatagaaggtgaggttcacagttggagcttttcttgccattgaccccaagctcaccccagccttccttccctgaccctgagactcaccctatctatctcccctattccctcagtttgcagaatgagcaagatagagtctggctaggagggaaacatctatccatctctctaatctttgcccatcacctcctgttgcaatgagttcccgcaggtgacatacggactggcctctctactgtactgggtgccatctcccaccatactctggcatttttatgtaaaggataatttcttgtacctgagtctaaaattacaacgttatcaaaattcacttcgtttttcctgcattttaaaagtaataaaatattatttgagattattttgaaattaaatatccttaaccaatgattaaattcataatcatttcatcttctttcataatcatttcatcttctaatctgaatttgttttgaacacagccttgcagaaaagcaaaaaatatttccccgctcaaattttgccgacattttataccagtatccccttcattacagtaaactaaatcataacttacatcatccattactagctgatcataaattgttagtattttaaggtatgcaactatgtgattgacatctgtaaggctagtttaatagacgtgctaaatatcactgttctgaatatctgtgccatagttctgatacccttattggaatcaaggcagtgctgtttctgtttacaagttatcaagataagagcagtggcatcacatttgttgttgttgtttttttttttgaaatagaaaaaaacagaagaagctctgccaacaataaaagattttgttaagtggtataaaaatttgtgaatgttgaaattcaacatgcttcatattataaccaacctgcaagaatattgtggtcaattgtgtgaataccaaatcagtatatactgtatactgtactatgaaaatttgtatttaaaggcaaagatacaagtaattgttggtataattggggaaaagggtattcaatatttattaagtaacaatgagaaatgcaacaaacttccttatttatgccttatgaataaaagagtgtggaatgtaaggtgaaattttatgtgcaagatcctgaaggaatgggtattcttgaaggcagggactgtcttttctatgtttgttctgtacagctctcagcacactcttggtgcttgataaatgttatgttatataataccaataactaagcacatttttagatcttttttcaaatggcttgtgtaaaatttggttaatgtacaatggttggtttgaagctatcatgtaaaattggcctctccaaatataatcagaaataaaccg

SEQ ID NO: 145893 - DNA, 5629 bp, Homo sapiens
  Payload ID: 8927
  Gene Symbol: KIAA1024
  Gene Name: KIAA1024
  ENST ID: ENST00000559272
  CDS Start-End: 53-2617
agaactgacctgaagtttcagtgtagtcagagagctcttcaagtaataaatcatggagaccagtcaggaaacttccctcttcttggtgaagatcttggaggaactggacagcaagcaaaataccgtttcttatcaggacctgtgcaaatctctctgtgcccggttcgacctgtcgcagcttgccaaactgagaagtgtgctcttctacacagcttgtctcgatcccaattttccagccacgctattcaaagacaagatgaaatgcactgtgaataaccagcaatcaaagaaaatcatggtggcagcagatattgtgacgatattcaacctgatccaaatgaatggcggggctgccaaggagaagctgcccacgggccgccagaaggtacgcaagaaggaggcatcctttgaatcatgtaggtcggacacagagatctgcaatgcagctgagtgtgagcccctgaactgtgagctgagtgagaggtctttcagccggggctaccccatcaggcagtcgtccaagtgccggaagatggactgcaaggactgcccacagtttgtccctgcctctgagcctaacttcctgttgggagttagcaaagaggtgaaaaaccgcgccgcttccctggacaggttgcaggccctggctccgtactctgtgaccagccctcagccctgtgagatgcagaggacctacttccccatgaacatcgaaaacgagtccatttcagaccaggactccctgcccatcaatcagagcatcaaggagaccttcatttccaatgaggagccatttgtggtccagtcctgtgtccagaaaaggaatatcttcaaagaggattttcacaatttgatggcagtgtcccccagtttggttggccccatcagcaaagcagagaatgagcacagggaaccccagagtcgaaaggaaccccacaagccacccttcttcaaccacagctttgaaatgccctataacagccagtacctgaatccagtgtattccccggttcctgacaaaaggcgagcaaagcacgaaagcttagatgaccttcaagcctctacatattttgggcccactcccgtgatgggaacccaagaagccaggcgctgtctagggaagcccaacaagcagactccctggccagccaaaagctggagcctaaacacagaggaagttcctgactttgaacggtcctttttcaatagaaatccctccgaggagaagctacactatccaaatgccagtagccagacccccaatttcccagccccagaaaggcgcccaacttaccttgtgccaaaggatcaacagccaattctccccattgcttatgcggcaaaacaaaatgggctcaaatctaaagagatctcatcccctgttgacctggagaagcatgaaccagtcaaaaagtttaaagacaagagcattaactgcaccagtgggcagctcagctcagacaccagtagcgtgggcacccagactgagcacgtgctggagcccaagaaatgcagagacctgtgcacctctggtcagggcaagtacagtgacaggcacaccatgaagcactcagacgatgactcagaaattgtcagcgacgacatcagtgacattttccgatttcttgatgacatgagcatcagtggctccacgggagtgatacagtcgtcctgctacaacagcacaggatccttgtctcagctccataagtcagactgcgacagttcccctgagcacaacttaaccaaaattgccaatggggtccccaacagcaagggagacaagggcaaccggcctgaaaacacccaccactcggaagaagagctgaagaccagtgtgtgcaaactggtgctcaggattggcgaaattgaacggaagctggaatccctgtcgggtgtccgtgatgaaatctcccaggtcttgggcaaactaaataaattggaccagaaaatgcaacagcctgagaaggtgagtgtgcagatagatctgaactccttgacaagcgagggtccgtctgatgacagtgcctctccccggatgttccacgcacacagtggctcccacggacccaaactagagaacaaccctgactggtgctgctctgatgctagcgggagcaacagtgaaagcctgcgggtcaaggccttaaaaaaaagcctcttcaccaggccatcctctaggtccctaacagaggagaacagtgccacagagtccaaaattgccagcatctccaactcgcccagagactggcgcaccatcacttataccaaccgtgtgggcctcaatgaggaggagataaaagacacaggcccaggagataataaagactggcatcggaaatctaaagaggcagacaggcagtacgacattcccccacagcaccgactgcccaagcagcccaaagatggcttcctggtggagcaggtgttcagccctcacccctaccctgcctccctcaaggcccacatgaagagcaaccccctgtacacagacatgcggctgaccgagttggccgaggtgaagcggggccaaccttcttggaccattgaggagtatgcacggaatgcgggcgacaagggcaagctgacagccctggacctgcagcacgtgggataagcatatttgtgggagccaagctatggattatgtttccatacggagcagccccagacgcaagaatctttaaacccaaataatttagagtactggatggaagacatttatactccaggatacgattcattactaaaacgtaaagaagccgaattcagacgagccaaggtctgcaagatagctgctctgatcgctgctgcggcatgcaccgtcatcctcgttattgtcgtgcccatctgcacaatgaaatcatgagctaagaatgcaaccttacgtacagcttatgactaccaatgtcgtcgtctgtatcttagaatcttgcagcagtgaggcaacaatttgttgaaatggagatgaaatcatggaggcatttctacaaatgttgaatgaaggtggttttcagaaagtatacattctagtgagaaatctacctacctattagctttgactcaattacactctgacgcatttttagaagtgcaatatcttttcctaccaaaagaacatcatggactatcaataaatacaaattgaatattccaagccaaaaaaggaagattaattgggttctttccattttgatgatgtttcatggtggggaataagttatacagaagatatttaatacacgcctctttagaagaaactaagggaaatagcaacataagaagaaaagaggtggcttctcttttccataatgttcttagaccattgctggtgaagtaacagggtgtgtgtccctaaagggtattacttctctgtcgacttttatcaagggctactgacgtttcattcttgcccttttgtcatcaacacgacagagtgtctgcatcactgcagatcttcatggaaacattctggaccttcttccttgcacttggagtgagaaggagctggactaccaagtcaggcgtggaatgaagtatgctcagactgcatgatgggccaaggtattcaggccaggagacctcgtcctcaatccaaagtgtaggggagctgcctgctaacgatgtaaggtcagtatttgaaaatcatggccactccaaaggatctcctgttcttgctttggtgtgtggctccattccttgattttctatctcctggtggtaccagatgctctgcctctcatacatgagttgaagagtttggaacttgtccttgtgccttgaagagtagagacaatggctaaacgttgacattctatctgtaaaccatggttttcacgcaccactaatatctgccattttcaatggctttaaaaagattttgaaagcttgctcaataatgttcaataatataataataataaaggcactgaggtcttctcagttaccccaacacctactccagagttttgaatacttgtcagcagtgcaaaaaatattatctgtttaaccacttatctatatgtctatctatctatctatatgtctatctatctatctaaatacttgatttttatttattgtcttctctgttaaataacttgagagcaaggtttctttcgtgtaaaagaagctgttgtaatttcatccaaatttgatctgtttccacctgctgaatggtgctctgacaataatggaacagaaagaatccttatcagcatctgattccaatgtcttgttacaggtcaaagaaaaaaggattgacagaaactagctaccttatatatattttttgataataaggtgggatataaatagattttggtagcaagtgtaatcactccgtatgatataataaatttctaaaagatttgagagcatctcaatttttaaagcaataggagtctagcatccattctgaaaaatcgcaaataatgcttagcttgctgtgtctgattctgttgttcaccattaaggggtagacagttaattttattatgttaacaagtgagggatgaatgttttcatctgtggtgaacctttatttttagaagtcttcatgttatctatttgtattatcatgtttatgtatggattttcaatttcagtaaccgaaaacttaagccttagtatgaaaaactgaggatttataattgaaaatgaaaaaaatatgttactctctatcatcagaattatagtctttggtgctctgttttcaatggggcatattacataaggttgtttctttcaccccaaagagactactaggttaccactctgggcattgcctttccacctaacccctcaaccagtaagactctacaccatattgtagccccactattctcctctttatcacagatgaagtgccagagcatcagagataggtagctcccaacctcttgctctggatttgcagaagagggggagatgtacttacccaggataagaaaaatctagtcaaatccaccccaaatcttccatttaacaggtaggaccatcgaggctggaccaaaccactttttccactgcccttggtgaatctattcctagtggaccccatttgggcatgtgcctagctaccttgggaaggcatgactataagtcacacctcaggcttggaaatgaaaggattctatagaatattctatactttccatagctggagaggtagtcagaaattcagtcttgctctgagtccacagtagctttaaaattcaactcaacattgttgtcacgtaacggaaacatctagacctggtaataatccaggaaattgcaaaatggaggccaaaagtaaggtgggtttctctggaaaggggtcatcctcagtctgataataccaagtctgacgctgaggttatgaatcattaccatggcttggagctattggatgcttggggtcttgggatagatagaaggtgaggttcacagttggagcttttcttgccattgaccccaagctcaccccagccttccttccctgaccctgagactcaccctatctatctcccctattccctcagtttgcagaatgagcaagatagagtctggctaggagggaaacatctatccatctctctaatctttgcccatcacctcctgttgcaatgagttcccgcaggtgaca

SEQ ID NO: 145894 - DNA, 2354 bp, Homo sapiens
  Payload ID: 8928
  Gene Symbol: KIAA1024L
  Gene Name: KIAA1024-like
  Uniprot ID: P59773
  ENST ID: ENST00000564719
  CDS Start-End: 113-685
gagagacttggtttcagatgcagtcagagcatcctcaggcacattaataatggaggagtctgacaagagcagctttgcctgtctttgttttccactgtaggtgaagggagacatggatctctctgttttgccaaataacaaccatcctgacaaattcctgcagcttgacgtaaagtctttaacgaggagctcagccctccttcaggccagcctggtgaggtttccgggtggaaattatcctgctgcacaacactggcaaaaccttgtctactcacagagggaaaagaagaatattgctgctcaacgaattaggggatccagtgcagacagccttgtcactgctgatagccccccaccatccatgtcatcagttatgaagaataacccactctatggtgacctaagtttggaggaagctatggaagaaagaaaaaagaacccctcatggaccattgaggaatatgacaaacattccctgcacacaaacctctctggacatctgaaggaaaatcctaatgacctgcggttttggttgggagacatgtacactccaggttttgacactttattgaaaaaggaagagaaacaagagaagcattcaaaattctgtcgtatgggtctgattttacttgtcgttatctccatcttggttaccatagtgactatcattacttttttcacctgaggaaactgcaacaatcagagctactttaaatttcctaaaaatttttctgataaacatttgaaaccccccccaccaaaataacaaaaaaacacatgtacatgcagtgtgaatggattgttgattgtattattaaatgtaattgtcctgaagaatgtgaatgtcaggcgtggtatgctggcttctccactttgttctataaaagctttctaagagtgccaccctgaactttgggaagcaggaattctgaggaccataatcacagaatagtcactatatgcaacccacattaaatatctttatagggagcaaacagtatcaaaaattgtcagcagctttgttttcatgcttaaactatattaaccttgttttaaaaatactgttaactctttaccacctcatcctcctgtgatcaccagaaaagtttgagctgataattttttttttaaccaactgctgggtagctaggataaaaatcttccagttgtgctgccaactgagttagattcattctctgttttattttcctgtatttctgtttaagtcagaaaaaaggaaaaagggaaatatcttattcaaatctattcttatttccccagtaatcatctatgatgccccaatttcatgttgcaattttaatagaattaaacttggataggccatagttacataattaattacatttagatccaatttatccaaattggctgtgacccctggtggcagtcagtgtgcatatattaccaaccatggtctaggttgggggtccctaggaaagcagagggaatactgctaagagaacagagtttgaagcctaactgctacttgctaacagactctggcaagttattctctcagagaaggaatgatattacctgcccaacagggctggccaaaggaccaaatacaaaacaggtatgaacagtatctggctcgaaataagcagttgcttaattaaaggcagttgttattattaatttatgctagctaattgacaacctgagtttaccttccattgtctgcagatacctggggacatggttgtagacacagatggggaatcaagtcaccatcctgcccttccttctagaacatcctttcctaagcccctcattcccactcttttctcatctttaaacaacccagccaaaggctatcttatgcaagaaacaaaagagggactttctcttcttctcatgagcctaaagtcagattttgtcccttgatattgccatatcattttgttgtatttgtcttaaagatgcttgaaataaagtacagtaaaagacagtttgggctgggcgcggtggctcgcgcctgtaatcccagcactttgggaggctgaggtgggtggatcatgaggtcaggagttcgagaccagcctggccaacatagtgaaaccccgtctctattaaaaatacaaaaattagccggggcttggtggcagacacctgtagtctcagctacttgggaggctgaggcaggagaatctctcgaaccctggaggcagaggttgcagtgagccgagattgtgccactgcactctagcctgggtgacagagtgagacttccataaaaaaaaaaaaaaaaaaaaaacaaacaaacaaacaaaaaaaaccccaaaaaaagagacagttttactggacaataaagttgttgtgtagaaaaaaaa

SEQ ID NO: 145895 - DNA, 5812 bp, Homo sapiens
  Payload ID: 8929
  Gene Symbol: KIAA1033
  Gene Name: KIAA1033
  Uniprot ID: Q2M389
  ENST ID: ENST00000332180
  CDS Start-End: 88-3609
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcggtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggagtaacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagcaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaattgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaatttc

SEQ ID NO: 145896 - DNA, 575 bp, Homo sapiens
  Payload ID: 8929
  Gene Symbol: KIAA1033
  Gene Name: KIAA1033
  ENST ID: ENST00000551224
  CDS Start-End: 228-575
atatttaatatagttatatataagtatgtatgtttatattttaagtgtagaaatatgtaacagttttactttttatgataagaactgaagtaaaatatagcaaaatattttggttcttaggagtggaaaccttgtaatttactactgtatgtaactatattcctattagaatttagagttatttatataaatatctgatttttttgtgtggtttttaaggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaa

SEQ ID NO: 145897 - DNA, 5819 bp, Homo sapiens
  Payload ID: 8929
  Gene Symbol: KIAA1033
  Gene Name: KIAA1033
  ENST ID: ENST00000550053
  CDS Start-End: 87-656
agtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcaggttttttgacagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcggtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggagtaacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagcaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaattgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaa

SEQ ID NO: 145898 - DNA, 359 bp, Homo sapiens
  Payload ID: 8929
  Gene Symbol: KIAA1033
  Gene Name: KIAA1033
  ENST ID: ENST00000552203
  CDS Start-End: 214-359
ccttttgatagagcagaaaaattcaatcgaggcatcagaaaacttggagtaacacctgagggacagagctaccttgatcaattcaggcaactcatcagccagattggacatgttggctctagggatggagcagtgaagaagacaaaggctgtactcatggatcttgaactctaggtgggggaagatgcagacagaaaaatacatagtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaag

SEQ ID NO: 145899 - DNA, 576 bp, Homo sapiens
  Payload ID: 8929
  Gene Symbol: KIAA1033
  Gene Name: KIAA1033
  ENST ID: ENST00000548195
  CDS Start-End: 452-576
agagctgtaggaactcctacggtggcgacagagagggaaacaggcttgttggaagaagcgcctggtcagcgttatcctcgaggatcatgccttcctgttaattccccaccccatcaattctacctttttagaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctcta

SEQ ID NO: 145900 - DNA, 719 bp, Homo sapiens
  Payload ID: 8929
  Gene Symbol: KIAA1033
  Gene Name: KIAA1033
  ENST ID: ENST00000547404
  CDS Start-End: 257-445
ggaggcgccggggtgatggcggtggagactctgtccccggactgggagtttgaccgcgttgacgacggctcgcagacttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcaggttttttgacagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctg

SEQ ID NO: 145901 - DNA, 5807 bp, Homo sapiens
  Payload ID: 8929
  Gene Symbol: KIAA1033
  Gene Name: KIAA1033
  ENST ID: ENST00000620430
  CDS Start-End: 88-3612
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcggtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacaggtaggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggagtaacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagcaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaattgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttg

SEQ ID NO: 145902 - DNA, 4556 bp, Homo sapiens
  Payload ID: 8930
  Gene Symbol: KIAA1107
  Gene Name: KIAA1107
  ENST ID: ENST00000370378
  CDS Start-End: 99-4163
cgtctcagcttcaagaaaaatgtattgcatttattgtagacaacttctccaagattattcagagtgaaaattttgctcttcttttacagtcacaagcaatgagcagcacagccgatctgttggacacaattttaaaagcaattgaagaaaatatcaccactgaaaatagctgctctcttcttatggctctggacacactgctgaactctgacagtacaaaggaaatgggttttacgtgcaagatccaggctctgcgtgataagctgtggatcttcctggttcagtctttctatgctgttcgtcacacagaaagctggaagctgatgagcacagatgatcaacagaaaatccaagcagctgcatttgacaaaggtgatgatcgaagacttggcaaaaagcctatattcagtagctcgcagcaaaggaaacaagtttctgactctggtgatataaaaatcaaatcttggaggggaaataacaagaaagagtgttggagttatctctctactaataaaaagatgaaatctgatggattaggagcatctggacattcgtcaagtaccaatagaaatagtataaataaaactctgaagcaagatgatgtaaaggaaaaagatggtacaaaaatagcatctaagattacaaaagaactaaaaactgggggaaaaaatgtttctggaaagcccaaaactgtaacaaaatccaaaacagaaaatggtgataaggcacggttggaaaacatgtcacctagacaagttgtagaaagatcagcaacagcagcagcagcagcaactggacagaagaatttactaaatggaaaaggagtgagaaatcaggaagggcaaatttcaggtgccagacccaaggtactcacaggaaacttaaatgtgcaagccaaagcaaagcctttgaagaaagctacagggaaggattcaccatgcctcagcatcgcaggaccctccagcagatccacagattcaagtatggaattctcaatttccactgaatgtctggatgaaccgaaagaaaatggatcaacagaagaagaaaagccttctggacataaactatccttttgtgattctccaggacagatgatgaaaaacagtgtagatagtgtcaaaaattccactgtagccataaaatctcgacctgtttcaagagttaccaatggaacttccaataaaaaaagtattcatgaacaagacactaatgtaaataacagtgtactaaagaaagtcagtggcaaaggatgtagtgagccagtaccacaggcaattttgaagaaaagaggaactagcaatggatgtactgcagctcagcagaggacaaagagtaccccatctaatcttactaaaactcaaggatcccaaggagagtcaccaaactcagtaaaatcttcagtctcttcaaggcagtctgatgaaaatgtggcaaagttggaccacaatacaactacagagaaacaagcacctaagagaaaaatggtcaagcaagtacacacagctttgcctaaggttaatgcaaaaatagtggcaatgcctaaaaatctaaatcagtcaaagaaaggtgaaactttgaataataaagattcaaaacagaaaatgcctcctggacaggttatatcaaaaactcagccttcctcccaaagacctttaaaacatgaaacatctactgtccaaaaaagtatgtttcatgatgtgcgtgataataacaacaaggacagtgtttctgaacagaagcctcacaaacctctcattaatcttgcatctgaaataagtgatgcagaagcactccagtcatcctgcaggcctgacccacaaaagccattaaacgatcaagaaaaagagaagttggcgttagaatgccaaaatatttcaaagctggataaatcattaaaacacgaactggaatcaaaacagatttgtttagataaaagtgaaacaaaatttcccaatcacaaagaaacagatgattgcgatgcagctaacatatgttgtcattctgttgggagtgataatgtaaattcaaaattttatagcaccacagccctaaaatacatggtttcaaatccaaatgaaaactccttgaactctaatccagtttgtgatttagactcaacaagtgcagggcaaatccatttgatatcagatagggagaaccaagtagggagaaaagatacaaacaaacaatcaagtattaaatgtgtggaagatgtttcactgtgtaatcctgaaaggacaaatggtaccttaaattctgctcaagaagacaaaaaatcgaaagttcctgtggaaggactgacaattcctagtaagttgtcagatgaatctgctatggatgaagacaaacatgctacagcagactcagatgtatcttccaagtgtttttcgggacagctatcagaaaaaaattctcctaaaaatatggaaacatcagaatctccagagagccatgaaactccagaaactccatttgtgggtcactggaatttgagtactggtgttctgcatcagcgagagagtcctgaatctgacactggcagtgctaccacctcctccgatgacataaagcccagatctgaagactatgatgctggagggtctcaggatgatgatgggtcaaatgacagaggtatctctaaatgtggcactatgctgtgccatgattttcttggaagaagtagcagtgataccagtactcctgaagaattaaaaatttatgatagtaatttaagaattgaagtaaaaatgaaaaagcaaagtaataatgatcttttccaagttaattcaacgagtgatgatgaaatccctaggaaaaggccagaaatttggtctcgatctgcaatagttcactctagggaaagagaaaatattccacgaggcagtgtccagtttgctcaggaaatagatcaggtatcttcttcagcagatgaaacagaagatgaaagatctgaagctgaaaacgttgcagaaaatttctctatatctaacccagctcctcagcagtttcagggaataattaatttagcttttgaagatgcaactgaaaatgaatgtcgtgaattttctgcaactaaaaagtttaaaaggtcagttttactttcagtcgatgaatgtgaagagctgggatcagatgaaggagaagtccatactccctttcaggcttctgtagattctttttcaccttctgatgtttttgatggcatttctcatgaacatcatggaaggacctgctattccagattctcacgagaaagtgaagataatattttagaatgtaaacaaaataaaggcaatagtgtatgtaaaaatgaaagcactgtcttggatcttagtagcattgactcttcaagaaaaaataaacagagtgtttcagccacagaaaaaaagaacacaatagacgtcctatccagtagaagcagacagcttcttcgagaagataaaaaagtaaacaatggaagcaatgtggaaaatgacattcagcaacgcagcaaattcttggatagtgatgtaaaatctcaagaaagaccatgtcacttggatcttcatcaaagagaacccaattctgacataccaaagaacagctctacaaaatctctagactcctttcggagtcaagttctgcctcaggaaggtccagtgaaagagagccattctacaactactgaaaaagctaatattgctttatctgcaggagacatagatgattgtgacacactggcacaaacccgcatgtatgaccatcggccttcaaaaaccctgtctccaatatatgagatggatgtaatagaagcatttgagcagaaagtggaatcagaaacacatgttacagatatggattttgaagatgaccaacattttgcaaaacaagattggacactactaaagcaactgctctctgaacaggattcaaacttagatgttacaaattccgttcctgaagacttaagtttagcacagtatctaatcaatcagacactacttttagcacgagatagctcaaaacctcagggtataacacatattgacactttgaacagatggagtgaactaacatctccacttgattcctcagcgagcatcaccatggctagtttttcctctgaagattgttcgcctcaaggcgagtggacaattctggaactggaaactcagcattaagtgttaacattttggaaaaatttatgccactcctttattttttgatgcctatattatatccaaatgataattgcattagccggatataaactttctttaatattgagtctttccaatttaatgaggtaaacatagtttatttattaatatatcacatatagaaaaatgtttttctaaagtttttgagcatgttttctctaattattagagaaattagaagacttataaggaaaccctagcttcagttttcctttcctagctgatgatttgttcacttaatcattattcaagaatttaaaatgtgaatgcagaagtagatcagtccctttactttttgctctgcatagggtaacatagtaatttaacaataaaaacttaccgtgcttgtgtcca

SEQ ID NO: 145903 - DNA, 15896 bp, Homo sapiens
  Payload ID: 8931
  Gene Symbol: KIAA1109
  Gene Name: KIAA1109
  Uniprot ID: Q2LD37
  ENST ID: ENST00000264501
  CDS Start-End: 374-15391
agtgccgcccggcctcggttgggacccctcccctcctcctccgcccccttgggtgtcggtggctgcggccagggtctggacctgggcggcggccccgggcggcggggctaaagggtgtgggcaccggcagagcttcgcaggctgcatccggctcggtgctgctgccgtcgccgcccctgccgccgcccaaggccctcggcgttccccggagagaggccagagggatttcgggctgcctcggcactcgcccaggtttgttaagatgaaacactgcagaaaggctatctgaagaaaagtagaaggaaaaacagaacgttgcaaactctggaaaaaaacttgggcctttagatgttgttctggaaaaactttagtaatggatcaaaggaagaatgagagtattgttcctagtataactcaattagaagattttcttacagaacacaattccaatgttgtttggctccttgttgctaccattttgtcctgtggatggattatttacctcacatattataattcccggaatgttggtcttattttaacactagttcttaacagattatacaagcatggctatatccatattggttccttctctttctctgttctttctggaaaagtcatggttcgtgaaatctattacattacagaagacatgtctattaggattcaagatggattcatcatttttcggtggtggaaaatgtataacccaaaacagaagcaacatgatccaaaggcagaaaccaggttatacatcacagtcaatgactttgaatttcatgtctataatcgctcggatctttatggacgccttcaagagttgtttggtttggagccaacaataattccacctaagaaagatgatgataaaacacgggaaattggaagaacaagaacccaatcgaaaattgaaagagttaaagtaaaaacagaatcccaagaccccacatcttcatggagatcacttattccagtcataaaggtcaatgtgagcacaggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgaaccaccgagattaatgggagaaggttttgtggtgatgcagtcaaatgatgttgacatctactactacatggatgagccaggacttgttccggaagaaacagaagaaaatattgaaggagaaatgagcagtgaggattgcaaattacaagacttgcctccatgttggggactggatatagtttgtggtaaaggaacagattttaattatggaccatgggccgataggcagagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggaaacaaatgctgtacatgtaaatgtaggagctggctcatatttagaaattaatattccaatgacagttgaagaaaatggttacactcctgctattaagggacaactcttacatgtggatgccactaccagcatgcaatatcggacccttttagaagcagaaatgttagcattccacatcaatgccagctacccccgaatatggaacatgccgcagacatggcagtgtgaattagaggtttataaagccacttaccacttcatctttgcacagaaaaacttctttacagatttaattcaagactggtctagtgacagtcctccagacattttttcatttgttccatatacgtggaattttaaaatcatgtttcatcagtttgaaatgatttgggctgctaatcaacacaattggatcgactgttctactaaacaacaggaaaatgtgtatctggcagcctgtggagaaacactaaacattgatttttctttgccttttacggactttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatggagccgatatttacattgttgagcatggttgtgctacaaatataaagatgggtgcaattcgagttgcaaactgtaatctccacaatcaatcggttggggaaggaatcagtgctgcaattcaggattttcaagtgagacagtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggttgtggtttttatggccagatgatatcctgaagaataagaggtgtagaaacaaatgtggttgtctcggtggctgcagattctttggtggcacagtaactggcctagatttcttcaaacttgaagagttgacaccttccagtagctctgcattttcaagcacaagtgcagagtctgatatgtattatggacagtctctgctacagcctggagaatggataattactaaagaaattcccaaaattatagatggtaatgtgaatggcatgaagaggaaagaatgggaaaacaaatcagtgggaatagaagtagagagaaaaactcagcaccttagtcttcaagtaccattacgatctcatagttcatcctcttcctcagaagagaacagtagttctagtgctgcacagcctttgttggctggtgaaaaggaaagtccttcatctgttgctgatgaccatttggttcaaaaagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagaaagcattcaggattccagaactctgccattcaaaactcatccttctcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggttatcaagcaggggctcacagctaattctttgctagacagaggcatgcaactttcaggatcaacttcaaatacgccgtatactccattggaaaaaaaactcgctgataacacagatgatgaaacattaacagaagagtggaccctggatcaaccagtgtcccagaccaggacaacagccatagttgaagtaaaaggaactgttgatattgttttgactcccctggtggctgaagctttagacagatatattgaagcaatggttcattgtgctagtacccgacatccagctgcaattgtagatgatcttcatgctaaagtcctcagggaagctgtccaaaatagcaagactaccttttcagaaaatttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaaacttatgtttgttacaagcctcagtggaagaatctccaactacggctcctagtaggagtgtgactcatgtttccctagtggcattgtgttttgacagaattgctacacaggttcgcatgaacagaggtgtggttgaagagacttcaaacaatgcagaacctggtagaacatcaaattttgataggtatgttcatgccacaaagatgcagcctcagtcatctggatctctcagatcaaatgctggagcagaaaaaggcaaagaaattgcagctaagttaaacattcatcgagttcatgggcaacttaggggtcttgatacaacagacattgggacctgtgcaatcactgctattccttttgagaagtccaaagttttatttactcttgaagagttggatgaatttacttttgtggatgaaactgatcagcaagctgttccagatgtaactcgaataggtcccagccaagaaaaatggggatggataatgtttgaatgtggacttgaaaatttaaccataaaaggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggatgaaggagtcgaatctgatgatttgaaaaaagatctacctctgatgcctcctcctccagattcatgtagcatgaagttgaccattaaagaaatttggtttagttttgcagctcccaccaatgtgagatctcacacacatgcattttctaggcagctgaaccttttaagcactgcaacaccagctgttggtgcatggcttgttcccattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaa

SEQ ID NO: 145904 - DNA, 4650 bp, Homo sapiens
  Payload ID: 8931
  Gene Symbol: KIAA1109
  Gene Name: KIAA1109
  ENST ID: ENST00000306802
  CDS Start-End: 1-4145
aaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacattgaaaaatacagtatggggaagtacaccacaatccagctgtcctggggaagggtattttcagtttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatgccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaa

SEQ ID NO: 145905 - DNA, 15574 bp, Homo sapiens
  Payload ID: 8931
  Gene Symbol: KIAA1109
  Gene Name: KIAA1109
  Uniprot ID: Q2LD37
  ENST ID: ENST00000388738
  CDS Start-End: 46-15063
gaaatcttttaggcctttagatgttgttctggaaaaactttagtaatggatcaaaggaagaatgagagtattgttcctagtataactcaattagaagattttcttacagaacacaattccaatgttgtttggctccttgttgctaccattttgtcctgtggatggattatttacctcacatattataattcccggaatgttggtcttattttaacactagttcttaacagattatacaagcatggctatatccatattggttccttctctttctctgttctttctggaaaagtcatggttcgtgaaatctattacattacagaagacatgtctattaggattcaagatggattcatcatttttcggtggtggaaaatgtataacccaaaacagaagcaacatgatccaaaggcagaaaccaggttatacatcacagtcaatgactttgaatttcatgtctataatcgctcggatctttatggacgccttcaagagttgtttggtttggagccaacaataattccacctaagaaagatgatgataaaacacgggaaattggaagaacaagaacccaatcgaaaattgaaagagttaaagtaaaaacagaatcccaagaccccacatcttcatggagatcacttattccagtcataaaggtcaatgtgagcacaggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgaaccaccgagattaatgggagaaggttttgtggtgatgcagtcaaatgatgttgacatctactactacatggatgagccaggacttgttccggaagaaacagaagaaaatattgaaggagaaatgagcagtgaggattgcaaattacaagacttgcctccatgttggggactggatatagtttgtggtaaaggaacagattttaattatggaccatgggccgataggcagagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggaaacaaatgctgtacatgtaaatgtaggagctggctcatatttagaaattaatattccaatgacagttgaagaaaatggttacactcctgctattaagggacaactcttacatgtggatgccactaccagcatgcaatatcggacccttttagaagcagaaatgttagcattccacatcaatgccagctacccccgaatatggaacatgccgcagacatggcagtgtgaattagaggtttataaagccacttaccacttcatctttgcacagaaaaacttctttacagatttaattcaagactggtctagtgacagtcctccagacattttttcatttgttccatatacgtggaattttaaaatcatgtttcatcagtttgaaatgatttgggctgctaatcaacacaattggatcgactgttctactaaacaacaggaaaatgtgtatctggcagcctgtggagaaacactaaacattgatttttctttgccttttacggactttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatggagccgatatttacattgttgagcatggttgtgctacaaatataaagatgggtgcaattcgagttgcaaactgtaatctccacaatcaatcggttggggaaggaatcagtgctgcaattcaggattttcaagtgagacagtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggttgtggtttttatggccagatgatatcctgaagaataagaggtgtagaaacaaatgtggttgtctcggtggctgcagattctttggtggcacagtaactggcctagatttcttcaaacttgaagagttgacaccttccagtagctctgcattttcaagcacaagtgcagagtctgatatgtattatggacagtctctgctacagcctggagaatggataattactaaagaaattcccaaaattatagatggtaatgtgaatggcatgaagaggaaagaatgggaaaacaaatcagtgggaatagaagtagagagaaaaactcagcaccttagtcttcaagtaccattacgatctcatagttcatcctcttcctcagaagagaacagtagttctagtgctgcacagcctttgttggctggtgaaaaggaaagtccttcatctgttgctgatgaccatttggttcaaaaagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagaaagcattcaggattccagaactctgccattcaaaactcatccttctcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggttatcaagcaggggctcacagctaattctttgctagacagaggcatgcaactttcaggatcaacttcaaatacgccgtatactccattggaaaaaaaactcgctgataacacagatgatgaaacattaacagaagagtggaccctggatcaaccagtgtcccagaccaggacaacagccatagttgaagtaaaaggaactgttgatattgttttgactcccctggtggctgaagctttagacagatatattgaagcaatggttcattgtgctagtacccgacatccagctgcaattgtagatgatcttcatgctaaagtcctcagggaagctgtccaaaatagcaagactaccttttcagaaaatttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaaacttatgtttgttacaagcctcagtggaagaatctccaactacggctcctagtaggagtgtgactcatgtttccctagtggcattgtgttttgacagaattgctacacaggttcgcatgaacagaggtgtggttgaagagacttcaaacaatgcagaacctggtagaacatcaaattttgataggtatgttcatgccacaaagatgcagcctcagtcatctggatctctcagatcaaatgctggagcagaaaaaggcaaagaaattgcagctaagttaaacattcatcgagttcatgggcaacttaggggtcttgatacaacagacattgggacctgtgcaatcactgctattccttttgagaagtccaaagttttatttactcttgaagagttggatgaatttacttttgtggatgaaactgatcagcaagctgttccagatgtaactcgaataggtcccagccaagaaaaatggggatggataatgtttgaatgtggacttgaaaatttaaccataaaaggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggatgaaggagtcgaatctgatgatttgaaaaaagatctacctctgatgcctcctcctccagattcatgtagcatgaagttgaccattaaagaaatttggtttagttttgcagctcccaccaatgtgagatctcacacacatgcattttctaggcagctgaaccttttaagcactgcaacaccagctgttggtgcatggcttgttcccattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacatttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaagtctgt

SEQ ID NO: 145906 - DNA, 4967 bp, Homo sapiens
  Payload ID: 8931
  Gene Symbol: KIAA1109
  Gene Name: KIAA1109
  ENST ID: ENST00000419325
  CDS Start-End: 1-4915
cattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctaactgtagtgaaatgtagtattgccaagtcccaagccctctacagtgcccaaagagggctgaagacaaacaatgctgctgtgttcaaagtaggagctatcagtatcaacattcctcagcaccctgccaccttacatagcatgatggttcgaagttctcaccaactatctaaacaaatctcagacctaatcagacagccttctacagccccacagcctgtaaaagaagatattgcaaccccactaccttctgaaaaaaccccaacaagtgttaatcaaactcctgttgaaacaaatgaatttcctcagctaccagaaggcttagaaaagaagcctattgttcttaaattcagtgccatgttagatggtatagccattggagcagcacttttaccatctctgaaagcagaatacaagatgggaagaatgagaagtcatggaatgacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagttggttcctttgaacataatcttacaactgatcttctaaaccacttggtatttgtacagaaagtgttcatgaaggaagttaatgaagtaatacaaaaagtttctggtggggagcagcctattcctctctggaacgaacatgatggaacagcagatggagataaacctaaaattctcctctattccctaaacttgcagttcaagggtattcaagtaacggccactactccatcaatgagagctgtaagatttgaaactggattgattgaactggaactttctaaccgacttcaaaccaaagcttcaccaggaagtagcagctatctgaaactgtttggcaaatgccaggtggatttaaatctggcattaggacaaattgtcaaacatcaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacagtctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacaatagcagaaattagaaggaagaagatcagcttcaaagttgtattctaatttcatagcatattaaacattatattaaaatgtttattttgttttttgtgta

SEQ ID NO: 145907 - DNA, 4476 bp, Homo sapiens
  Payload ID: 8931
  Gene Symbol: KIAA1109
  Gene Name: KIAA1109
  ENST ID: ENST00000446180
  CDS Start-End: 1-4343
acagtaggggttccatatatcacagtgtagaagggccacttactggacatggagaaagcattcaggattccagaactctgccattcaaaactcatccttctcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggttatcaagcaggggctcacagctaattctttgctagacagaggcatgcaactttcaggatcaacttcaaatacgccgtatactccattggaaaaaaaactcgctgataacacagatgatgaaacattaacagaagagtggaccctggatcaaccagtgtcccagaccaggacaacagccatagttgaagtaaaaggaactgttgatattgttttgactcccctggtggctgaagctttagacagatatattgaagcaatggttcattgtgctagtacccgacatccagctgcaattgtagatgatcttcatgctaaagtcctcagggaagctgtccaaaatagcaagactaccttttcagaaaatttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaaacttatgtttgttacaagcctcagtggaagaatctccaactacggctcctagtaggagtgtgactcatgtttccctagtggcattgtgttttgacagaattgctacacaggttcgcatgaacagaggtgtggttgaagagacttcaaacaatgcagaacctggtagaacatcaaattttgataggtatgttcatgccacaaagatgcagcctcagtcatctggatctctcagatcaaatgctggagcagaaaaaggcaaagaaattgcagctaagttaaacattcatcgagttcatgggcaacttaggggtcttgatacaacagacattgggacctgtgcaatcactgctattccttttgagaagtccaaagttttatttactcttgaagagttggatgaatttacttttgtggatgaaactgatcagcaagctgttccagatgtaactcgaataggtcccagccaagaaaaatggggatggataatgtttgaatgtggacttgaaaatttaaccataaaaggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggatgaaggagtcgaatctgatgatttgaaaaaagatctacctctgatgcctcctcctccagattcatgtagcatgaagttgaccattaaagaaatttggtttagttttgcagctcccaccaatgtgagatctcacacacatgcattttctaggcagctgaaccttttaagcactgcaacaccagctgttggtgcatggcttgttcccattgaccaactcaagtcatctttaaacaaattggaaactgagggaaccttgagaatttgtgctgttatgggatgcataatgacagaagcattagagaataaaagtgtacattttcccctaagaagtaaatacaacaggcttacaaaagttgctcgctttctccaagaaaatccttcatgtttactatgtaatatactacaccactatctgcaccaggcaaattactccatcattgatgatgctacaatgagcgatggacttcctgctttggtaactttgaagaaaggtttagttgcactggcaaggcagtggatgaagtttattgtggtgacaccagcctttaaaggagttagcttacatagaccagctcagcctctgaaacctcaaatagctatggaccatgaacatgaagatggacttggattggacaatgggggtggtcttcaaagtgataccagtgctgatggagcagaatttgagttcgatgcagccacagtcagtgaacacacaatgctattagaaggaacagctaaccggcctccacctggtagctctggacctgtaactggagctgagataatgaggaaactttctaaaactcatacccatagtgactctgcattaaaaataaagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggttgttttcaagcctcttctgagtcatacagggatccagtcacaggatacaatgccattctgctaccgaatgtactttggagaacacctttcattttcagggactttggactgcctcagagcagatattgtggattcagacacagccaaagagagaaaaggcaaaagagcaagaaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgactctgattcaattacagtgtcagaacaaagtgagccttcagctgagtgctggcagaatatgtataaattgcttaacttctattcacttatctccgatccaacaggaatattggaaaagtcttcagaaacatttggaccagcaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaagatgttttacatcaaaagatgactgagacttgtgctactgctcatattggtggggttaatattgtgctgcttgaagggattacaccaaatatacaactggaggattttcctacatctcctacaagtacagccaaacaagagtttctgtatgtcatattattctttttcatggctttgtaattactgtagtattgaatagtttttaaaatatttaaatttttttcatggctgtgaattatttagttattgttttgtagctgtaatataggcccttttatataatagattaaagcttactggtaatcaaggaaaa

SEQ ID NO: 145908 - DNA, 619 bp, Homo sapiens
  Payload ID: 8931
  Gene Symbol: KIAA1109
  Gene Name: KIAA1109
  ENST ID: ENST00000442707
  CDS Start-End: 1-592
atttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctggtactcaattttatagtttttaaattaaaatactgttttccaaaattaaa

SEQ ID NO: 145909 - DNA, 3741 bp, Homo sapiens
  Payload ID: 8931
  Gene Symbol: KIAA1109
  Gene Name: KIAA1109
  ENST ID: ENST00000424425
  CDS Start-End: 1-3741
acgggaaattggaagaacaagaacccaatcgaaaattgaaagagttaaagtaaaaacagaatcccaagaccccacatcttcatggagatcacttattccagtcataaaggtcaatgtgagcacaggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgaaccaccgagattaatgggagaaggttttgtggtgatgcagtcaaatgatgttgacatctactactacatggatgagccaggacttgttccggaagaaacagaagaaaatattgaaggagaaatgagcagtgaggattgcaaattacaagacttgcctccatgttggggactggatatagtttgtggtaaaggaacagattttaattatggaccatgggccgataggcagagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggaaacaaatgctgtacatgtaaatgtaggagctggctcatatttagaaattaatattccaatgacagttgaagaaaatggttacactcctgctattaagggacaactcttacatgtggatgccactaccagcatgcaatatcggacccttttagaagcagaaatgttagcattccacatcaatgccagctacccccgaatatggaacatgccgcagacatggcagtgtgaattagaggtttataaagccacttaccacttcatctttgcacagaaaaacttctttacagatttaattcaagactggtctagtgacagtcctccagacattttttcatttgttccatatacgtggaattttaaaatcatgtttcatcagtttgaaatgatttgggctgctaatcaacacaattggatcgactgttctactaaacaacaggaaaatgtgtatctggcagcctgtggagaaacactaaacattgatttttctttgccttttacggactttgttccagctacatgtaataccaagttctctttaagaggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtctggttgggttgaatgctggactgtcccaagtgtcatgcttacaattgattatacatggcatccaatttatccacaaaaagcagatgaacagctgaaacaatcattatcagaaatggaagagacaatgctatctgtattaaggccatcccagaagacatcagacagagttgtttcttctccctctacttcttcacgcccacctattgatccctcagaacttccacctgataaacttcatgtagaaatggaactttctccagattctcagataactctctatggacctctactaaatgcctttttgtgtataaaggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagctggcatgcctcttggagtggggacagacatttgtttttcatgtggtatgtcgggagtatgaactggaaagaccgaaatcagttataatatgtcagcatggaattgatcgtcggttctgtgaatccaagttgagttgtattcctgggccttgtccaacttcagatgatttgaaatatactatgattcgtttagcagtagatggagccgatatttacattgttgagcatggttgtgctacaaatataaagatgggtgcaattcgagttgcaaactgtaatctccacaatcaatcggttggggaaggaatcagtgctgcaattcaggattttcaagtgagacagtacattgagcaattaaataattgcagaattggacttcagcctgcagtgctacggagggcctattggcttgaagctgggtcagccaatttaggacttattactgttgatattgctttagctgctgaccatcattctaaacatgaggcacaaagacatttcttagaaactcatgatgccagaactaagaggttgtggtttttatggccagatgatatcctgaagaataagaggtgtagaaacaaatgtggttgtctcggtggctgcagattctttggtggcacagtaactggcctagatttcttcaaacttgaagagttgacaccttccagtagctctgcattttcaagcacaagtgcagagtctgatatgtattatggacagtctctgctacagcctggagaatggataattactaaagaaattcccaaaattatagatggtaatgtgaatggcatgaagaggaaagaatgggaaaacaaatcagtgggaatagaagtagagagaaaaactcagcaccttagtcttcaagtaccattacgatctcatagttcatcctcttcctcagaagagaacagtagttctagtgctgcacagcctttgttggctggtgaaaaggaaagtccttcatctgttgctgatgaccatttggttcaaaaagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtag

SEQ ID NO: 145910 - DNA, 624 bp, Homo sapiens
  Payload ID: 8931
  Gene Symbol: KIAA1109
  Gene Name: KIAA1109
  ENST ID: ENST00000421930
  CDS Start-End: 1-624
tctaatcatactggagaccttgacactggttctgctttggtattaaccattgaaagtactctcatcactgcatgctcttcagagtctctggttagcaaagggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctggagaggaagacatagatgacattgctgacttaaattcagtgaacatagctgacctgtcagatgaggatgaagttgatactatgtctcccactatccatactagttcagatggaagttcaataagtggagatggccacaaactcacctttgggcagcgacttgtaaatcacctactaggcctgacacccccaaatcagcgccattctgttcctgcagagtatctgtgtgacccagagatgtggggctcccctcagtctagccagtcccatttgaaagcatgcagagcacactcatggggaaacgaagccacagattatcgaagacaggcagcatctgctagccagccgggagaacttagaggaaga

SEQ ID NO: 145911 - DNA, 5528 bp, Homo sapiens
  Payload ID: 8931
  Gene Symbol: KIAA1109
  Gene Name: KIAA1109
  ENST ID: ENST00000438707
  CDS Start-End: 1-5025
gggcatttcaaaaacttttgtatccgttttgctgatggatttgagacatcatgggatgactggaaaccagaaattcatggggatttagtgatgaatgcctgtgtagttccagatggcacctatgaagtatgttcaagaactacaggacaagcagcagctgaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactagttcagatggaagttcaataagtggagatggccacaaactcacctttgggcagcgacttgtaaatcacctactaggcctgacacccccaaatcagcgccattctgttcctgcagagtatctgtgtgacccagagatgtggggctcccctcagtctagccagtcccatttgaaagcatgcagagcacactcatggggaaacgaagccacagattatcgaagacaggcagcatctgctagccagccgggagaacttagaggaagaaaaattatgaagcgtatagtggatatcagagaactgaatgaacaggccaaagtaatagatgatctgaaaaaattaggtgcaagtgaaggaaccataaaccaggaaattcaacgttaccaacagttagaatctgtggctgtgaatgacattagaagagatgttcgtaaaaaattacggaggtccagtatgcgggctgcttccctaaaggataagtggggtttgagttacaaaccaagttacagccgatcaaaaagcatttctgcttctggaagaccacctcttaagcgaatggaaagggcaagttctcgagtaggagaaactgaagagctcccagaaatccgtgtggatgcagcatctcctggacctagagtaacttttaatatccaggatacattgaaaaatacagtatggggaagtacaccacaatccagctgtcctggggaagggtattttcagtttccagaggagacagaactggaccttttgtcagtaaccattgaaggtccatcccattattcatcaaatagtgaaggatcatgttctgtgttcagttctcccaaaactccaggaggcttttcaccaggcattcctttccaaactgaagagggccgacgggatgacagtttgtcttctaccagtgaagattccgagaaggatgaaaaagatgaagaccatgagagggaaaggttttatatttacaggaaaccctcacatacgtctcgtaaaaaagcaacaggctttgctgctgttcatcagctatttacagaacgctggccaacaacaccagtcaatagaagtcttagtggcacagctacagagagaaatattgactttgaacttgatatacgggttgaaattgatagtggaaaatgtgtactccacccaaccacccttctacaagaacatgatgatataagtttgagaaggagttatgatcgaagttccaggagcttagatcaagattcaccttcaaaaaagaagaagtttcaaactaattatgcttctaccacccatttaatgaccggcaagaaagtgccatcatctctacagacaaagcctagtgacttagaaacaacagtattttacattcccggagttgatgtaaagttgcattacaattccaagacgctaaagactgaatcacctaatgcctccaggggatcttccttgccaagaacactgtccaaagagtccaagctgtatgccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacagctgtcagctcacaagatgaagatatgggacattttgaaataccagatcctatggaagaatcaacaacatcactagtgtcgtcttcaacatctgcttactcttccttccctgtagatgttgtggtttatgtacgagttcagccctcacagatcaaatttagctgtttaccagtatcaagagtagaatgcatgttaaagctgccatccctggatttggtgttttcttcaaaccgaggagaactggagactttagggactacatatcctgcagagactttatcccctggaggtaatgctactcagagtggaacaaagacttctgctagcaaaactggaataccaggttcatcgggattaggcagccctcttggccgaagtcgacatagtagtagtcagtcagacctgaccagttccagcagtagttcatctggcttgagcttcactgcatgcatgtctgacttttccctttatgtatttcatccatatggagcagggaaacaaaaaactgctgtttctggcctcacacctggatcaggaggattagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctgctgtttgtgatatagggtctgcctcctttaaatatgatatgcgccgactcagtgaaattctggcatttccaagagcatggtatagaagaagtattgcaagacgtctattccttggagaccaaactataaatttgccaacatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagagattcactttcaaaaacatcaactccttttaacaaatcaaacaaagcagcaagccaacaagggaccccatgggaaacacttgtcgtgtttgctatcaacttgaagcaattaaacgttcaaatgaatatgagtaatgtaatgggaaatacaacttggacaactagtggtttgaagagccagggccgtctgtcagtaggaagtaatcgtgatcgagagatcagcatgtctgttggtctgggaagatcacaattagattctaaaggaggagtagttggagggaccatagatgtcaatgctttggagatggttgctcatatttctgaacatccaaatcagcaacccagtcacaaaattcagattactatgggttctactgaagctcgtgttgattacatgggctcaagtatcctcatgggcatcttcagtaatgctgatcttaagcttcaggatgaatggaaagtaaacttgtataatacattggattcaagcataactgataaaagtgagattttcgtccatggagatttgaagtgggatattttccaagtaatgatatcaaggtcaaccacaccagatctgataaaaataggaatgaagctccaggaatttttcacacaacaatttgataccagcaaacgagctctgtctacctggggaccagttccttaccttccgccaaagacaatgactagcaacctagaaaaaagttcacaagaacaattacttgatgcagcacatcatcgacactggcctggagtattgaaggtggtatcaggatgccacatatccttatttcagattccattaccagaagatggaatgcaatttggaggatcaatgagcttacatggaaatcatatgacactggcatgttttcatggtccaaattttcgttcaaaatcttgggccctttttcatttagaagaaccaaatattgctttttggactgaagctcagaaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtagcaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgactttaaatccattcatgttcaagaaccacaggagccttcattacaggatgccagcctgaagccaaaagtagaatgtagtgtggtgacagagttcactgaccacatttgtgtgactatggatgctgagctcatcatgtttcttcatgatttagtatcagcttatcttaaagaaaaagaaaaagccatctttccacctcggattttatctactcgaccaggacaaaaaagtccaattattatacatgacgacaattcctctgataaagatagagaagatagcatcacttatactactgtggactggagagattttatgtgcaatacatggcatctagaacctactcttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggttt

SEQ ID NO: 145912 - DNA, 492 bp, Homo sapiens
  Payload ID: 8931
  Gene Symbol: KIAA1109
  Gene Name: KIAA1109
  ENST ID: ENST00000449251
  CDS Start-End: 1-492
aatgaaggttcagccaagtcaattcatccacttgccttgcgtccttgggatattactgtacttgttaatttgtacaaagttcatgggcgtcttcctgttcatggaactactgatggtcctgaatgccctacagctttcttggaaagactatgttttgaaatgaaaaaaggatttagggagaccatgctgcaacttatcctgtcacccctgaatgtgtttgtcagtgataactatcagcagcgaccccctgtggatgaagtactcagggaaggtcacatcaatttgtcaggtctccagctgagagcacacgctatgttctcagcagaaggtcttcctttgggaagcgattccttagaatacgcatggttaattgatgtgcaggctggaagtcttacagctaaggtcacagcaccacagttgagttgtattcctgggccttgtccaacttcagatgatttgaaatatactatgattcgtttagcagtagatgga

SEQ ID NO: 145913 - DNA, 5122 bp, Homo sapiens
  Payload ID: 8932
  Gene Symbol: KIAA1143
  Gene Name: KIAA1143
  Uniprot ID: Q96AT1
  ENST ID: ENST00000296121
  CDS Start-End: 61-525
gcctctgtatcgtcgcgaatccgtcgcggaacctgtcttctgtctttacccagagctaccatgagcaagcggaaccaggtatcgtacgtgcggccagccgagccggcgtttctggcccgcttcaaggaacgggtcggctacagggagggacccaccgtagagactaagagaattcagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattacgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatgcagtcctaagtaatacaataaataactggtcaaactgttactggtggagggtgtccaggttcttggcattttggacaaataattgaacaaaacgcacaaagcaatgaatatcctctagaggtttgccattggttacttggcgtacaccctgtgtaaatgaagtagtggcccgtgacctgtctgattggtgcagaaagtgaccaatcagaggctgaagtgaagttacaaagttatactcctgtgtaaatgaggacttggcctatgaccagtctgattggttgcaggaggggaccaatcagaggcactttcatttttcatctgcaatgcagaaaaggcaaggggattgcaaagggagtagcctctgatccttttgttacttaggtatggagaggtggggttttccttttgattcagttctaggaagtcaatgtgaatcagccttaggttccctgtctccagaccctattctcctgcctcattttccccctgagagacgtgatcctcgtaaatctttatgggaggctgagagactgagggtctttcttctgtaactgcttcatgctaacttgggacacagtccctacctattggagatcacgtaactctcaccctgctttgtctaggggagacagggtagcttcttgatggccggtggtgtcttctcctgaaactggctagaaatcttgtcacatgatcatctaacttggtggtctctaggcaaaaggaaatggatttggttaaaagatttaacagatatggtccaaaaaccaaggcaaatataatcattaataatgggctggccaagggagggagccatgaaacccaacttagtgccctttaggtgccccagctgttgtcatattttagaggcccagtcagctagttttcaggtggtgtcccttactaatcctgattggttgacatcaaaacagcattcttcttctaggaaaatacataagccacctgtttcagcagttaggagatctagtccccttcgattttgcaaagcgaccactgccaaggagcctatccgaatttgtaaggtgacaatactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcagagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggctcatgcttgtaatcccaacactttgggaagccaaggtgggagaattgcttgaagccaggaatctgagcccagcctgggcgacaaagcaatacccctatctctacaaaaaataaaaaatagccaggtgtagcgacacacacctgtagtcccagctgctcaggaggctaagcaggaggatggcttgggcccaggagttcaacgctgcagtgagctatgattgcaccactgcactccagcctgggcaacagagtaagaactgtctcaaaaaaaataaaaaatagaaataaattttaaaaaaagaattacccatattctctttgtttttgtttattcacattaacctttattctatctggaatttattagagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccaggctggagtgcagtggcgcgatctcagctcactgcaagctccgcctcctgggttcacaccattctcttgcctcagcctcccaagtatctgggactacagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatgaa

SEQ ID NO: 145914 - DNA, 5122 bp, Homo sapiens; identical to SEQ ID NO: 145913
  Payload ID: 8932
  Gene Symbol:
  Gene Name: KIAA1143
  ENST ID: ENST00000627745
  CDS Start-End: 61-525

SEQ ID NO: 145915 - DNA, 1847 bp, Homo sapiens
  Payload ID: 8933
  Gene Symbol: KIAA1147
  Gene Name: KIAA1147
  ENST ID: ENST00000482493
  CDS Start-End: 66-1121
ctcctctcctctgagtcccagccccacagtggtgttcgcacttcagtgacagggcatccggaaacatggtagaatggtgcttacctcaagatattgaccttgaaggtgttgagttcaagtctatggccagtgggtcccataaaatccaatctgatttcatctatttccgaaaggggcccttcttcggcctggcctgctttgccaacatgcccgtggagagcgagctggaacgtggcgcgcggatgaagtctgtgggcatcctctctccctcctacacactgctttaccgctacatgcacttcttggagaaccaggttcggcaccagttggagatgccaggacattactctcatctggctgccttctatgaggacaaaaagggggtgctccatgctggtcccggcagaggcagcagcctgccccctgtctactggctgccttccatccaccgatacatgtaccctgagatgaagttctttggagaacagatcctcatcctctggaaatttgccttacttcgaaagcgcattttgatattttctcccccacctgtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccacttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttctt

SEQ ID NO: 145916 - DNA, 7296 bp, Homo sapiens
  Payload ID: 8933
  Gene Symbol: KIAA1147
  Gene Name: KIAA1147
  Uniprot ID: A4D1U4
  ENST ID: ENST00000536163
  CDS Start-End: 1-1368
atggtggagcagggagacgcggcgccgctgctgcgctgggccgagggccccgccgtctccctgccgcaggccccgcagccgcaggcgggaggctggggccggggcggcggcgggggcgcccggccggccgcggagccgccccggaggcgggagcccgaggagccggccgccccggaggtgctgctgcagcccgggcgcctggagctgggcgacgtggaggaggaccaggtggtggccgtgttcgtggtcaccttcgacccccgctcgggaaacatggtagaatggtgcttacctcaagatattgaccttgaaggtgttgagttcaagtctatggccagtgggtcccataaaatccaatctgatttcatctatttccgaaaggggcccttcttcggcctggcctgctttgccaacatgcccgtggagagcgagctggaacgtggcgcgcggatgaagtctgtgggcatcctctctccctcctacacactgctttaccgctacatgcacttcttggagaaccaggttcggcaccagttggagatgccaggacattactctcatctggctgccttctatgaggacaaaaagggggtgctccatgctggtcccggcagaggcagcagcctgccccctgtctactggctgccttccatccaccgatacatgtaccctgagatgaagatcacacacccagctggctgcatgtctcagtttataaagttctttggagaacagatcctcatcctctggaaatttgccttacttcgaaagcgcattttgatattttctcccccacctgtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccacttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcttcttgcctctcaagggttgaggggtcctttctgtcaagtaatggttatttttcgtggtatcctgaggttcagggtgttttaagctgggggtaggtggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaa

SEQ ID NO: 145917 - DNA, 7296 bp, Homo sapiens; identical to SEQ ID NO: 145916
  Payload ID: 8933
  Gene Symbol: KIAA1147
  Gene Name: KIAA1147
  Uniprot ID: A4D1U4
  ENST ID: ENST00000575464
  CDS Start-End: 1-1368

SEQ ID NO: 145918 - DNA, 1847 bp, Homo sapiens; identical to SEQ ID NO: 145915
  Payload ID: 8933
  Gene Symbol: KIAA1147
  Gene Name: KIAA1147
  ENST ID: ENST00000574704
  CDS Start-End: 66-1121

SEQ ID NO: 145919 - DNA, 6398 bp, Homo sapiens
  Payload ID: 8934
  Gene Symbol: KIAA1161
  Gene Name: KIAA1161
  Uniprot ID: Q6NSJ0
  ENST ID: ENST00000297625
  CDS Start-End: 125-2269
gcgcaggggatcggcgggaagctctttcacccccgcttctgccgggctgtaactgcaatggagcaggttgagatgaactcagtcagatggccccacggcccgctcctttcttagcagcccactaatgctccagaaccctcaggagaagagccaggcctacccccgccgccgccggcctggctgctacgcataccgtcagaaccccgaggccatcgcagccgcagctatgtacaccttcctgcccgacaacttctcacctgccaagcccaagccttccaaagacctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggtcttccgcctggccttccgctccggcgcgctggaccttgactcctgcagccgcgatggcgccctgctgggctgctcgctcacggccgacgggctgccgctgcacttcttcatccagactgtgcggcccaaggacacggtcatgtgctaccgcgtgcgctgggaggaggcagcgccgggccgggccgtggagcacgccatgttcttgggcgacgcggcggcccactggtatggtggcgccgagatgaggacgcaacactggcccatccgcctggatggccagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatccacaagtacatggtgcgtcgctacttcaacaagccgtcaagggtgccagcacccgaggccttccgagaccccatttggtccacatgggcgctgtacgggcgcgccgtggaccaggacaaggtgctgcgttttgcccaacagatccgcctgcaccacttcaacagcagccacctggaaatcgacgacatgtacacacctgcttatggcgacttcgacttcgatgaggtcaaattccccaacgccagcgacatgttccgccgcctgcgcgacgccggcttccgcgtcacgctctgggtgcacccttttgtcaactacaactcgtcgcgcttcggcgagggcgtggagcgcgagctgttcgtgcgcgaacccacgggccggttacctgcgctggtgcgctggtggaacggcatcggcgcggtgctagacttcacgcacccaaaggcccgcgactggttccagggacacctgcggcggctgcgctctcgctactccgtggcttccttcaagttcgacgcgggcgaggtcagctacctgccgcgggacttcagcacctaccggccgctgccggaccccagcgtctggagccggcgctacactgagatggcgctgcccttcttctcgctggcggaggtgcgcgtaggctaccagtcacagaacatctcctgcttcttccgcctggtggatcgcgactctgtgtggggctacgacctggggttgcgctcactcatccccgcggtgctcaccgtcagcatgctgggctacccattcatcctacccgatatggtgggcggcaacgccgtgccccagcggacagccggcggcgatgtgcccgagcgcgagctctacattcgctggctggaagtggccgcctttatgccggccatgcagttctctatcccgccctggcgctacgacgcggaagtggtggccatcgcgcagaagttcgccgccctgcgggcctcgcttgtggcaccgctgttgcttgagctggcgggcgaggtcaccgacacgggtgaccctatcgtgcgccccctttggtggattgcgcccggcgacgagacagctcaccgtatcgactcgcagttccttattggggacacgctgcttgtggccccggtgctggagccaggcaagcaggagcgcgacgtctatttgcccgccggcaagtggcgcagctacaagggtgagcttttcgacaagacgccggtgctgctcaccgattacccggtcgacctggatgagatcgcctactttacctgggcgtcctgacccagcccagggcccggtaaccgcaaagcccccagtcttcatgcagaccttgaaccctccgtcacacccgcaccatgtactcccaggaacctcccacctctataccacccattaagtggctgctgacttaaatgtgctggaaccagctgctgaaggtggggcctagggagggggcactgaagcaatctcctgctccaacgcacaatccttactgtgccctttccacccccacactcacaccaatctgcagaaacctcttccctggggtggaagccagagagcttagaggaaaaaggtcagctctcttcctgttatacatggttatacatggttggggtttaaaagcacaaagagaaacctccccctcctggctttcgtggccatctttgtccatcttaggtggggacttgatcttatttaaggtctccaaatagcccccaccacacttagaacgtgtgttttcttagtgttagaagccaggccctgagtccccagcactcacctgaactgtggctgatttggtcccagtccagctggggaggtgtttggctgacaaggaggcaagagatcccctcccagggaacaggaggactgggcttagcacagagccatcatcatgttcccaatttgtgaagagactcctaacactgcactaacccatttgtgtacatacatgggctcagccctgggccaaatgtgcctgatgggaacagacttgcagggccatgcaggccagacttcgtgccttaactgaagagtgtgcgtgtgtgtgtgtgagagagagagagagagagaaacacgcatcatgggtccctgatctatgaaatgaacacaacctctctgaggctggatgatctggaggaagggggcatggagcaaatttgaggctctgattgctgagccagcctcctcccaggcggtttccccaggactctcgtaggaaataaatagccctttcaagattcctcagctgcctcaccccctgcacatgtgcctggggtgtggcctagaagggagtgatgttcttactctggtggtctgtgcttctgaacacaggctacatgcacacactgacaactaccaataaacagacaggggaaggtctttcatctcagccattttctcttccccccgcccccccttagatggagtcttgctctgtcacccaggttggagtgcagtggcacaatcagctcactgcaacccctcctcctaggttcaagcgattgagtagctgagattacaggcatgcatcactatgcctggctttttgtattttttagtagagatggggtttaccatgttggccaggctagtctcaaactcctgacctagtgatgcacccaccttggcctcccaaagtgttgggattacaggcatgagccaccacgccagccattttctctttctaagaagagcaacctcagccggagtgagttttttctgactttgcagctgagtctggagaaaagtggcatgccagagcgggtcggtgggaaacagggtgaactttagcttccatcaacagctctggtagcaaaaccagtcccctaccccctagagaatgcatccgtttccccacctgatatggtttggctgtgtccccacctaaaactcatcttgaattgtagctcccataattgccatgtgttgtgggaaggacccagtgggagataattgaaatatgggggcagtttccgccatactgttctggtgatagtgaatagatctcatgagagctgatgattttataagaggtttccccttttgcttagttctcattctctcttgcctgccgccatgtaagacgtgcctttctgtcatgcttgtgaggcctccccagccacgtggagctgtgagttcattaaacctctttttctttataaattacccagtcttggttatgtctttatcagcactgtgaaaatgaacctatacagtaaattggtaccagtagagtggggcgctgctgtaaatacccaaaaatgtggaagcaactttggaactgggtaacaggcagaggttggaacagtttggagggatcagaagacaggaaaatgtgggaaagtttgggacttcctagagacttgttaaatggctttgaccaaaatgctgataatgattgggacatgaaatccaggctgagttggtctcagatagcgatgaggaacttgtttggtactggagtaaaggtgactcttgctatattttagcaaagagactggctgcattttgcccctgccctagagatttgtggaactttgaactcgagggagatgatttagggtatctggcagaagaaatttctaagcagcaaagcattcatgaggtgacttgggtgctgttaaaagcattcagttttaaaagggaaacagactataaaagtttggaaaatttgcagcctgatgatgagatagaaaagaaaaacccattttctgaggataaattcaagccccctgcagaaatttgcataagtaacaaggagccaaatgttaatcactaagacatggggaaaatgtctgcagggcatgtcagagacctttgcagcagtgcctcccatcacaggcctggaggcctaggagggaaaaaatggttttgtgggccaggcccaaggtccccttgctgtgtgcagcccagggacttggtaccatgcatcccagctgctctagtcatggctaaaaggggccaagatacagctcaggccttggcttcagagggtgcaagccccaagtcttggcatcttccacgtagtgttgagcctgcaggtgcacagaagtcaagaactgaggtttgggaacctctgcctagatttcagagaatgtatggaaatgcatgtatgtccaggcagaagtttgctacaggagtgaggccctcatggagaacctctgttaaggcaatgtggaaggggaagcccccacacagagaccccactgggacactgcctagtagagctgtcagaagaaggccaccgtcctccagacatcagaatggtatatccactgacagcttgcaccatgcacctggaaaagccacagacactcaacgccagcctgtaaaagcaaccgagaagtaggctgtaccctgcaatgccataggggtggagctgcccaagaccatgggaacccacctcctgcatcagtgtgacctggatgtgagacatggagtcaaaggagaccattttggagctttaagatttaactgccctgctggatttcagacttgcatggggcctttagccacttcgttttggccaacttctcccacttgaaatgggtgtatttagccaatgcctgtacctccgttgtatctaggaagtaactaactagcctttgattttacaggctcataggtggaagggacttgccttgtttcagatgagactttggagtatggacttttgagttaatgctgaaatgagttaagactttgggggactgttgggaaggcatgattgatttttaaatgagaggacatgagatttgggaggggccagggagagaatgatatggtttggctgtgtccccatccaaatatcaccttaaattgtagctcccataattgtgggagggacctggtgggagataattgaatcataggggcagtttctcccatactgttctggtggtagtgaataagtctcacgagatctgatggtttaataaggggtttccccttttgcttggctctcattctctcttgtctgctgccatgtaagatgtgccttttgccttccaccatgattgtgaggcctcccagccacatggaactgtgagttcattaaacctctttttcttcataaattacccagtctcgggtatgtctttatcagcagtgtgaaaacagactaatacaccactcctctaccttctttattttctcagtgtggaaaatgcctgatgaaagctttggggccctcacagatgcacaactcaagtgctgattctatcacttatctaccagctctgtgaccttgaacaagccgcttaaccttgctaagcctctgttttctcatatgtcaaatggtgataataatgcctacctcccgaggttgttgtaagaattataagcacaaatgtatgtaaagtgcctggcacaaagtaggtgctcaataaatggtagctattataat

SEQ ID NO: 145920 - DNA, 480 bp, Homo sapiens
  Payload ID: 8934
  Gene Symbol: KIAA1161
  Gene Name: KIAA1161
  ENST ID: ENST00000379142
  CDS Start-End: 1-480
ttcctgcccgacaacttctcacctgccaagcccaagccttccaaagacctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatc

SEQ ID NO: 145921 - DNA, 2991 bp, Homo sapiens
  Payload ID: 8935
  Gene Symbol: KIAA1191
  Gene Name: KIAA1191
  Uniprot ID: Q96A73
  ENST ID: ENST00000298569
  CDS Start-End: 535-1452
ggcgtttcctctcggggctggcggattccacactcggagctgcggctccacaactcgctgggcggcgaagggcatggggagggggcgggtctcgcgatcgtggacaacaactcccagcatgccctgtgctccgctgggccaagtctcgcgcgagatcccgcggtctccggaggctttatctgcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacagaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaat

SEQ ID NO: 145922 - DNA, 2700 bp, Homo sapiens
  Payload ID: 8935
  Gene Symbol: KIAA1191
  Gene Name: KIAA1191
  Uniprot ID: Q96A73
  ENST ID: ENST00000393725
  CDS Start-End: 302-1162
tggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacagaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 145923 - DNA, 1243 bp, Homo sapiens
  Payload ID: 8935
  Gene Symbol: KIAA1191
  Gene Name: KIAA1191
  Uniprot ID: Q96A73
  ENST ID: ENST00000510164
  CDS Start-End: 220-1137
actgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctggg

SEQ ID NO: 145924 - DNA, 512 bp, Homo sapiens
  Payload ID: 8935
  Gene Symbol: KIAA1191
  Gene Name: KIAA1191
  ENST ID: ENST00000506983
  CDS Start-End: 226-512
ggctttatctgcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagaccca

SEQ ID NO: 145925 - DNA, 639 bp, Homo sapiens
  Payload ID: 8935
  Gene Symbol: KIAA1191
  Gene Name: KIAA1191
  ENST ID: ENST00000503082
  CDS Start-End: 430-639
gcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctggtaaacttaattctttttgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgac

SEQ ID NO: 145926 - DNA, 486 bp, Homo sapiens
  Payload ID: 8935
  Gene Symbol: KIAA1191
  Gene Name: KIAA1191
  ENST ID: ENST00000504688
  CDS Start-End: 291-486
ggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggttggaatgcagtggcacgatcttggctctctgcaacctccgcctcctgggttcaagcaattctcctgcctcagtctcccaagtagctgggactacagctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgt

SEQ ID NO: 145927 - DNA, 560 bp, Homo sapiens
  Payload ID: 8935
  Gene Symbol: KIAA1191
  Gene Name: KIAA1191
  ENST ID: ENST00000533553
  CDS Start-End: 331-453
ggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcag

SEQ ID NO: 145928 - DNA, 2452 bp, Homo sapiens
  Payload ID: 8935
  Gene Symbol: KIAA1191
  Gene Name: KIAA1191
  ENST ID: ENST00000620366
  CDS Start-End: 243-917
ggtctccggaggctttatctgcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacagaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctc

SEQ ID NO: 145929 - DNA, 2631 bp, Homo sapiens
  Payload ID: 8935
  Gene Symbol: KIAA1191
  Gene Name: KIAA1191
  Uniprot ID: Q96A73
  ENST ID: ENST00000614420
  CDS Start-End: 236-1096
ggtctccggaggctttatctgcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacagaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctc

SEQ ID NO: 145930 - DNA, 7824 bp, Homo sapiens
  Payload ID: 8936
  Gene Symbol: KIAA1210
  Gene Name: KIAA1210
  Uniprot ID: Q9ULL0
  ENST ID: ENST00000402510
  CDS Start-End: 1-5130
atgagggccggctggacgcctcgaggcttctctgcctttcacgcttctctccttcctggccggcacccctacctggctcacctgggccccagggaccgaggggccaggattggaagtcgagcgtattcccaaggctgttgcagttgtctttggttgacttacaaaggcaagaaggagggaagcaccaagggggagcttggcccagctgcagtgactgacctggaaatacctagttattcccggggcttcctgccctgcacaccgcgattccctaccacttggtgcaggggacctggatgcttttgtggcactgcagtgattgctggtaatcttggggatctggccaggatagtgggcccctcacatcatgctagtcagcttctcctactccaagaacaggattcaggaaatcatcctacaatggctgaatcactaagtgaaatttctgacagtctggatgttctggaggccggtgatgagggaaagaagaaatgcaaatttaaagcccttaagagcttttttgttaagaagaaggaaaaagaagccgaagatacccaggaagaagaaatgctagaactgagcttgtccagcagcaacattaacatctcttctctgcagcccgttcgggaaaatcaaccaactaaggccagggccaagagcagcatggggagcaaagccctatcccatgatagcatcttcatgttgggtcctgagcctgaaagatcagcaagtaaaatgtttccttctatggatccccagagaggcagacctcagcagagatcccatatttccagaactctgcctaaacctaggagtaaggttcctggagttgtgtctggagccatgtcaggagctgtgcttcaaaatgtgcctacaagtgcagtctgggttgctggccccaagatcactgagaacccaccatcgcgccgacgccgactcagcatcatcccacctgttatccaacctgaaataatttctaagaacttggtagaaatctctctcgatgatgagtcacctaagaatccacaaaagaaggctttaccacataagagtttgacagcgactcagagcttctctgagttatcatctggacctgattgctcacagtccttgactgcatttgccacacttgcctctaccagtagcacccagctgcccattggtttcagcaccccagccaccacccagggctgtttggattcttcagctgctcgccacaaaatgactttaaatccccgcaaacaaaagaagaaccttcaagtgattattcgtggccttccagtgtggttcagtcatttccagggtattttagagggatccctgcagtgtgtcactcagacattagaaactccaaacctggatgaaccacttccagtggaaccaaaggaggaggagccaaaccttccattggtttctgaagaagaaaagagcataaccaaaccaaaagaaatcaacgaaaagaagctgggaatggacagtgcagattcctcaagccagaaacagaacaacaaaactgagatgtatgataagaagacaacagaccaggctccaaacactgatgcttctcggagtcagggctatccaatgtcagcagcatatggaagaagatggagaagaaaaggagcaagtgtttcaggattgagtgggtgtgaattcaaaggaagaagccttaaacaatccagtgaagggtatggcctgggcgatagagctgggtcttcacctaccaataagactgccaggaatgtccctttctcgcacttgtccttagagaaggacaacatggagcagcctacaacttcacaaccagaaaccactacccctcaggggttgctttcagataaagatgacatgggaaggagaaatgctggcatagatttcggatccagaaaagcatcagcagcacagcccatacctgaaaacatggacaattccatggttagtgatccacaaccataccatgaagatgcagcttctggagctgagaagacagaagccagagcttctctctcactgatggtggaaagcctttctacaacccaagaggaggccattctctcagtagcagcagaggctcaggtgtttatgaatccttctcatatccagttagaagatcaagaagctttcagctttgatttacaaaaggcccaatccaaaatggagtcagcccaggatgttcaaactatctgcaaagaaaagccttctggaaatgttcaccagacctttacagcaagtgttttgggtatgacaagtactacagccaaaggagatgtttatgccaagactctgcctcccagaagcctttttcagtcctcaaggaagcctgatgctgaagaagtctcctcagattcagagaatattcctgaggagggggatggttctgaagaactggctcatggtcactcttcccagtccttggggaagtttgaagatgaacaagaagtcttctcagaatcaaaaagttttgttgaggacttgagcagctctgaggaggagctggacctcagatgcctctcccaggctttagaggagcctgaagatgcagaagtcttcacagaatcaagcagttatgttgaaaagtacaacacttctgatgattgcagcagctcagaggaagacctgcctctcagacaccctgctcaggccttgggaaagcccaaaaaccaacaagaagtctcctctgcttcaaataatactcctgaagagcagaatgattttatgcagcagctgccttccagatgcccttctcagcccattatgaatcctactgttcagcaacaagtccccaccagttcagtgggcacttctataaaacagagcgattccgtggagccaatccctccaagacaccctttccagccatgggtgaaccctaaagtggagcaagaagtttcctcatctccaaagagcatggctgttgaagagagcatttctatgaagcctctgcctcctaaacttctttgccagcccttgatgaatcctaaagttcaacaaaacatgttctcaggttcagaggacattgctgttgagagagtcatttctgtggagccactactccccagatattctcctcagtccttgacagatcctcaaatccggcaaatctcagaaagcacagctgttgaggaaggcacttatgtggaaccgctgcctcccagatgcctttcccagccctcggagaggcctaagttcctggactcaatgagtacttctgcagaatggagcagtcctgtggcaccaacaccttccaaatacacttccccgccatgggtgacccctaaatttgaggaactgtatcaactctctgcacatccagaaagcactactgttgaagaggacatttctaaggagcagctgcttcccagacatctttcccagttgactgtgggaaataaagtccagcaactgtcctcaaatttcgagcgggctgctattgaggcagacatttctgggagtccattgcctccccaatatgctacccagttcttaaagaggtctaaagttcaggaaatgacctcacgactagagaaaatggctgttgaaggcacttctaacaaatcaccgattcccaggcgtccgacccagtcattcgtgaaatttatggcacagcaaatcttttcagagagctctgctcttaagaggggcagtgatgtggcacctctgcctcccaatcttccttccaaatctttatcaaagcctgaagtcaagcaccaagttttctcagattcagggagtgctaatcctaagggaggcatttcttcaaagatgctacctatgaagcaccctttacagtccttggggaggcctgaagacccacagaaagttttctcttattcagagagagctcctgggaagtgcagcagttttaaagagcagctgtctcccaggcagctttcccaggccttgaggaaacctgagtatgagcaaaaagtctcccctgtttctgccagttctcctaaagagtggaggaattctaaaaagcagctgcctcccaaacattcttcccaagcctcagataggtctaaattccagccacagatgtcatcaaagggcccagtgaatgtacctgtaaagcagagcagcggtgagaagcacctgccttcaagtagtcctttccagcaacaggttcattcaagttctgtgaatgctgctgctaggcgatctgtttttgagagcaattctgacaattggttcctaggaagagatgaagcttttgcaatcaaaaccaagaaattcagccaaggttccaaaaaccccataaagagcattccagcccctgctaccaaacctgggaagttcaccattgctcctgtcaggcaaacatccacttctgggggcatttactctaagaaagaagatcttgagagtggtgatggtaataataaccagcatgcaaacctatccaatcaggatgatgttgaaaagctttttggagttcgactgaaaagagcccctccctcgcagaagtataagagtgagaaacaagataacttcacccagcttgcttcagtgccctcgggcccaatttcatcctctgtaggcaggggacataaaatcagaagcacttcccaggggctcctggatgctgcagggaacctcaccaaaatatcttacgttgcagataagcaacagagcaggcccaaatctgaaagcatggccaagaagcaacctgcttgcaagaccccaggaaagcctgctggtcaacagtcagattatgctgtctcagagccggtttggataactatggcaaagcagaagcagaagagtttcaaggcccacatttctgtgaaagagctgaaaactaagagcaatgctggagccgatgctgagactaaggagcctaaatatgagggagctggctctgcaaatgaaaaccaacctaaaaagatgttcacttccagtgtccataaacaggagaagacagcacagatgaagccacctaagcctacaaaatcagttggatttgaagctcagaagatactgcaagttcctgccatggaaaaagaaaccaaacgatcttcaactctcccagccaagttccagaacccagttgagccaattgagcctgtctggttctcactggccaggaagaaagccaaagcatggagccacatggcagaaatcacgcaataaagagctcttgtgtggagcatcagcatttattttatttagtttttttttttttttttttttttgagacagagtctcgctctgttacccagattggagtgcagtggcgcgatctccgctcactgcaagctccgcctcccgggttcacgccactctcccgcctcagtctcccgactagctgggactacaggcgcccgccatcacgcccggctaattttgttttcgtatttttagtagagacggggtttcaccatgttggccaggatggtcttgatctcctgacctcgtgatccgcccgcctcagcctcccaaaagctgggattacaggcgtgagccaccgcgcccggccaagcatcagcgttttaaatgataattgctaatagctgtattaattctatgtagtgatctttttactgtgaccacttgtattaagcaaaataagtattaagcaaactaagaatttattaagcaaaataagaatttattaagcaaaatagccttagaaatgcaaattaaaacataattatttgaatgaaataaatgccatgaatgcttaaccttccacgtagtcactgccagcacccagaaacccagcatttcctctattaaaactatcgaaaacatttgcactgctgtaaaattgcaaaatctttaactttggacaatgtgctttagaagggagaaagcaaaaacattttgttggagcaactagaaaattgtcatttccctcaaccaaataaagtaattctaatggaaacattcagatgatttgacctaaagattggcctttaggttttatgagcctagatagatgccgcaattatttggttgttgctctaagctttgcaagggatcctaaaagaggcggtggaagtgaaaattctgggtctccaagaaaatttctgcacagccagttctccaatcagcctatcaccccttgaaacatcttccctgtgtccctgggggcccctgatgctttctccttgggtgatagtaacatgcagagcacttacacaaagctccctctttggacataccccacgtcgacctgtcacaggcctggctgtagcgagcacctccctatgacgcagaatgcttcttgggaattatcttactcctctggagggttagtccatcaatgttttgcttcttgtcccaatactactgtgaccctctctgatcgcacagaaatcactgcctatcacatatatcctgttaagcactgaagaccctattgaaattagagttctacagatgccaaaagctgtactttccatcaggcagatggcaagcttactgccttgatgcacatctggagccactggagctccttcctctctggttccagcattaaggtggagaactccatgtagcttcttgtcctttcccctcagctgtctttgcttcacaaggttttagcccaaagcaagagtgcaatcccaaagccacagagaaatgaactttccgctacctggaagctttaagtgagtaaatcagcttttcccctctcattcctagaggcacacacctcaaaagttactaggctggagagaccctaccttccagtgacccactcatcccccagccacggagaagagggaagaccaaaaagggagagtgagaaagaggatgagagggatggtcagctgtgaggggagggggcaagtggcccagcaaatgttgatgcctcccttcccatcttgccacacggtctttttcttttgtagcacagcctccattaataactcctcggctgaggatgaagatgtaggcacctttacccccagagccagttccttaattggctggctttctgagatgcagaccaccctagaatctcatctaggttcactagaagttagttaaatcttcctttctctgtctttctcttcattccatcccccaaacccaccaaacactaagggagagctccctttggatgtctgggcagtaaacctagctcatttttctaggagacccagaagtgacttctgagtagttatcactgtgtctgcctctgttacactgtgctgctttgcttaaacagaaatgcaggcctggacatctgactgtgcctttatattctgagtggggtgctgccccatgcaaaaaaatccagagaggtagtgaggtgtcagagctaaacacttggtgctgggttttgttgatgctggtataatgtgacacagtacaattacatgctaaattttgcattttctctatataacatctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctccaataacaatttcttttccacagttaacaacaaagttctgtttttaaatgaagagattaagttctttttaaatgcctaaaggcatattctgacaacttttctacttctttaacttttttgatttaagatatatgcaaagcaaataaattcaataaagccta

SEQ ID NO: 145931 - DNA, 4109 bp, Homo sapiens
  Payload ID: 8937
  Gene Symbol: KIAA1211
  Gene Name: KIAA1211
  Uniprot ID: Q6ZU35
  ENST ID: ENST00000264229
  CDS Start-End: 392-4093
acatgccttctggtttgactggagtaatcctggtagaatccacgtagctctgaagacttacaagagcagtgattcccaggctttctcagcaatgtaccccatttcctgacatttacagctgaaggtgaagtttcccttttgcaaggagaaaattttggtggagaattatccaacaagaaaaagacctgtggctattaagatagacaagaagaagggaggcaaattccagccttttaaaaagttgtttggcaaaaggaaaaagaaagacccttcgttgttccgggtgccgtcgttggggaagaagagttactctcaccagagtgtcagcaatgggaccttctcttcggatgaggagaccctggaagacaatctaaggtccttcaactattctatgggaacccgggcattttcccatgacagtatttttatccctgatgggggagcagaaagtgagcagacagttcaagcaatgtcacaggacaacatcctgggcaaagtcaaaactcttcagcaacagttgggcaagaatatcaagtttgggcagcggtcacccaatgccattcccatgaataaggcaaacagtggagaggctagcttagaagaggatctgttcctgaccagtcccatggaaattgtgactcagcaggacatcgtcctctcagacgcagagaacaagtccagtgatacgccaagttctctaagtcctctgaatctccctggagctggaagtgagatggaagagaaggttgctcccgttaaaccgtctcggccaaaaaggcacttctcttctgctggcaccatcgaaagtgtcaacttagatgccatccccctggccatcgctcgcctggacaacagtgccgccaagcacaagctggctgttaagccaaaaaaacagagggtgtcaaagaagcacaggcgccttgcccaggatccacaacatgagcaaggcggccttgagagtcggccctgcctggaccagaacggacacccaggcgaggacaagccaacgtggcacgaagaggaacccaatccgctggattccgaggaagagagaagacgccaagaagactactggcgagaactggaggccaagtgcaagcggcaaaaggcggaagcagccgagaagagacgcctagaggagcagaggctgcaggcgctggagaggaggctttgggaagagaacagaaggcaggagctcttggaggaggagggcgaggggcaggagccgcctctagaggcggaaagggcgccgcgggaagagcagcagcggagcctggaagcgccaggttgggaggacgcggagcggagggagcgtgaggagcgcgagcgcctggaggcggaggaggagcgaaggcgtctgcaggcccaggcccaagcggaggagaggcggcggctggaggaggacgccaggctggaggagcggaggcggcaggaggaggaggaaggaagatgcgcggaggagctcaaaaggcaggaggaggaggaggctgagggatgggaagagctggaacagcaggaggcggaggtgcaggggccgcccgaggcgttggaggagactggggagggccggcggggcgcggaggaggaggatctgggggaagaggaggaggagggccaggcgcacctggaggactggagggggcagctcagtgagcttctgaacgactttgaggagaggctcgaagaccaggaacgcctgaaacccgaaggacaaagagaacactccgaggagccaggtatttgcgaggagcagaacccagaggccgagcggcgaagagagcagcagggaaggagcggggatttccagggggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagccccgccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagaggcccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcaccc

SEQ ID NO: 145932 - DNA, 4628 bp, Homo sapiens
  Payload ID: 8937
  Gene Symbol: KIAA1211
  Gene Name: KIAA1211
  Uniprot ID: Q6ZU35
  ENST ID: ENST00000504228
  CDS Start-End: 106-3807
ccgtcgttggggaagaagagttactctcaccagagtgtcagcaatgggaccttctcttcggatgaggagaccctggaagacaatctaaggtccttcaactattctatgggaacccgggcattttcccatgacagtatttttatccctgatgggggagcagaaagtgagcagacagttcaagcaatgtcacaggacaacatcctgggcaaagtcaaaactcttcagcaacagttgggcaagaatatcaagtttgggcagcggtcacccaatgccattcccatgaataaggcaaacagtggagaggctagcttagaagaggatctgttcctgaccagtcccatggaaattgtgactcagcaggacatcgtcctctcagacgcagagaacaagtccagtgatacgccaagttctctaagtcctctgaatctccctggagctggaagtgagatggaagagaaggttgctcccgttaaaccgtctcggccaaaaaggcacttctcttctgctggcaccatcgaaagtgtcaacttagatgccatccccctggccatcgctcgcctggacaacagtgccgccaagcacaagctggctgttaagccaaaaaaacagagggtgtcaaagaagcacaggcgccttgcccaggatccacaacatgagcaaggcggccttgagagtcggccctgcctggaccagaacggacacccaggcgaggacaagccaacgtggcacgaagaggaacccaatccgctggattccgaggaagagagaagacgccaagaagactactggcgagaactggaggccaagtgcaagcggcaaaaggcggaagcagccgagaagagacgcctagaggagcagaggctgcaggcgctggagaggaggctttgggaagagaacagaaggcaggagctcttggaggaggagggcgaggggcaggagccgcctctagaggcggaaagggcgccgcgggaagagcagcagcggagcctggaagcgccaggttgggaggacgcggagcggagggagcgtgaggagcgcgagcgcctggaggcggaggaggagcgaaggcgtctgcaggcccaggcccaagcggaggagaggcggcggctggaggaggacgccaggctggaggagcggaggcggcaggaggaggaggaaggaagatgcgcggaggagctcaaaaggcaggaggaggaggaggctgagggatgggaagagctggaacagcaggaggcggaggtgcaggggccgcccgaggcgttggaggagactggggagggccggcggggcgcggaggaggaggatctgggggaagaggaggaggagggccaggcgcacctggaggactggagggggcagctcagtgagcttctgaacgactttgaggagaggctcgaagaccaggaacgcctgaaacccgaaggacaaagagaacactccgaggagccaggtatttgcgaggagcagaacccagaggccgagcggcgaagagagcagcagggaaggagcggggatttccagggggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagccccgccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagaggcccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaacctttggtaatggttttttgattctatgcactaattttctttgtccaaaacatttactctaccatatgtctgggaatgtttatcctttctacagtaatggtgaaaggatcatatctagctaaaagcaagaacacccattctcctgaatgcagtgagtaattgggaatcacaaggaacattctggcacccaactgtgcccatcttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagacaattctagatcagagctacaagttcactttctgtctctgagaatctccatctagggcagtagttcttatgatgtgtaggc

SEQ ID NO: 145933 - DNA, 4117 bp, Homo sapiens
  Payload ID: 8937
  Gene Symbol: KIAA1211
  Gene Name: KIAA1211
  ENST ID: ENST00000541073
  CDS Start-End: 149-3829
ccgtcgttggggaagaagagttactctcaccagagtgtcagcaatgggaccttctcttcggatgaggagaccctggaagacaatctaaggtccttcaactattctatgggaacccgggcattttcccatgacagtatttttatccctgatgggggagcagaaagtgagcagacagttcaagcaatgtcacaggacaacatcctgggcaaagtcaaaactcttcagtcgactaagcagtatgttcctgcaacagttgggcaagaatatcaagtttgggcagcggtcacccaatgccattcccatgaataaggcaaacagtggagaggctagcttagaagaggatctgttcctgaccagtcccatggaaattgtgactcagcaggacatcgtcctctcagacgcagagaacaagtccagtgatacgccaagttctctaagtcctctgaatctccctggagctggaagtgagatggaagagaaggttgctcccgttaaaccgtctcggccaaaaaggcacttctcttctgctggcaccatcgaaagtgtcaacttagatgccatccccctggccatcgctcgcctggacaacagtgccgccaagcacaagctggctgttaagccaaaaaaacagagggtgtcaaagaagcacaggcgccttgcccaggatccacaacatgagcaaggcggccttgagagtcggccctgcctggaccagaacggacacccaggcgaggacaagccaacgtggcacgaagaggaacccaatccgctggattccgaggaagagagaagacgccaagaagactactggcgagaactggaggccaagtgcaagcggcaaaaggcggaagcagccgagaagagacgcctagaggagcagaggctgcaggcgctggagaggaggctttgggaagagaacagaaggcaggagctcttggaggaggagggcgaggggcaggagccgcctctagaggcggaaagggcgccgcgggaagagcagcagcggagcctggaagcgccaggttgggaggacgcggagcggagggagcgtgaggagcgcgagcgcctggaggcggaggaggagcgaaggcgtctgcaggcccaggcccaagcggaggagaggcggcggctggaggaggacgccaggctggaggagcggaggcggcaggaggaggaggaaggaagatgcgcggaggagctcaaaaggcaggaggaggaggaggctgagggatgggaagagctggaacagcaggaggcggaggtgcaggggccgcccgaggcgttggaggagactggggagggccggcggggcgcggaggaggaggatctgggggaagaggaggaggagggccaggcgcacctggaggactggagggggcagctcagtgagcttctgaacgactttgaggagaggctcgaagaccaggaacgcctgaaacccgaaggacaaagagaacactccgaggagccaggtatttgcgaggagcagaacccagaggccgagcggcgaagagagcagcagggaaggagcggggatttccagggggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagccccgccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagaggcccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgcca

SEQ ID NO: 145934 - DNA, 278 bp, Homo sapiens
  Payload ID: 8937
  Gene Symbol: KIAA1211
  Gene Name: KIAA1211
  ENST ID: ENST00000514330
  CDS Start-End: 1-257
ctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaattggagatctccgactcggctcccccagcgccgctggtaaaagaagtcaccaagaggtttt

SEQ ID NO: 145935 - DNA, 830 bp, Homo sapiens
  Payload ID: 8937
  Gene Symbol: KIAA1211
  Gene Name: KIAA1211
  ENST ID: ENST00000629263
  CDS Start-End: 720-830
gaccacgccgcgcggggccgggcgcgcagtgccgcgcggtggcggcagtggggagagcaatggaggccacggccgactgagaggcgggtgcgctgctggtgctgctgccgcggcggctgctgatgcggaggctgccgcgcgcagtgccgccgagtccgccgcccgcccgggaccgccggtcgccggccagccgctctgccagccggagcgccaggcggggacctcagcttacaagagcagtgattcccaggctttctcagcaatgtaccccatttcctgacatttacagctgaaggtgaagtttcccttttgcaaggagaaaattttggtggagaattatccaacaagaaaaagacctgtggctattaagatagacaagaagaagggaggcaaattccagccttttaaaaagttgtttggcaaaaggaaaaagaaagacccttcgttgttccgggtgccgtcgttggggaagaagagttactctcaccagagtgtcagcaatgggaccttctcttcggatgaggagaccctggaagacaatctaagatttgcatgttacttaataaattctggttggcaagacttactgggacaaaactgatagtgacagctcagctggagaaaggctcttccaattaaaagttctgcagtgccttctgtcttggatcctatacaaataagtaactgtctttgtgttctcacggtccttcaactattctatgggaacccgggcattttcccatgacagtatttttatccctgatgggggagcagaaagtgagcagacagttcaagcaatgtcacaggacaacatcctgggcaaagtcaaa

SEQ ID NO: 145936 - DNA, 3907 bp, Homo sapiens
  Payload ID: 8938
  Gene Symbol: KIAA1211L
  Gene Name: KIAA1211-like
  Uniprot ID: Q6NV74
  ENST ID: ENST00000397899
  CDS Start-End: 333-3221
aggggagctgagcggcgtccgcccccgccgagccgagcggagccgagcgaagccggcgcgcctgcagctgggagctgggagctgggagcgcgccgggcgcagggccgggccggccgcgggagggtagtgtcagcgcccgcgtccagctcttcggccgcagacccgggctgtctggaggccgcgcggccacctgctgcgtcgccccggctttgggctggggctagacgcgcaccgcggcgggagcagccccggctcgccgcaccccgcggaaggtgcccttctctgcgcgtctcgccgagcccgggccacgctcctgtcccagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggaggagtcgaggggcacgctgggcagccgggccctttctcacgacagtattttcattcctgagtccggacaggacgctactcggcctgtgcgggtgttttcccaagaaaatgtgtgtgatcggattaaagctctgcagttaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtcctggtaccaccataaaggtctctgtcgtgtctccagaccacgtgagcgacagcaccgtctctgcccggatctcagacaacagcctggcaccagtggctgacttcagttatcctgcagaatcctcctcctgcctggacaactctgcagctaagcacaagctccaggtcaagccccgcaaccagcggtcgagtaagatgaggcggctctcatcgcgcgctcagtctgaatccctgagcgacctgacgtgcaccccagaggaggaggaaaacgaggagaagccacttttggaagtcagcccagaagagcgccccagctctgggcagcaggacgtggcgccagacagaggccctgagcctgggccaccggcgcccttgccgccacccggaggggcccgtgccagacgcgcccgcctgcagcactcctccgcgctcacggccagcgtggaggaggggggcgtccccggggaggacccctcaagccgcccggccaccccggagctcgccgagcccgagtcggcccccactctccgcgtggagcccccgtccccgccggagggccccccgaatcccggtcccgacggcggaaagcaggatggggaggcgccccccgcaggcccgtgtgccccggccacggacaaggcggaggaggtggtctgtgctcccgaagacgtcgcgagcccgtttcccaccgccatccctgagggggacacgactccccccgagactgaccccgccgccacctcagaggcgccctctgctcgcgacgggccagaacgcagtgtcccgaaggaagcggagccgacgccgcccgtgctcccggatgaggagaaggggcccccagggccggcgcctgagcccgagagagaagcggagacggagcccgagagaggagcggggaccgagcccgagagaattgggaccgagccctccacggcgcccgccccgagcccgccggcgcccaagagctgcctgaaacaccggcccgcggccgccagcgagggccccgccgcgtccccgccgcttgccgctgcggagtctcccccggtggagcccggccccggttccctcgacgcagaggccgccgccccggagcgccccaaggccgagcgagccgaggcgccaccggcgggcgccgagagggcggcgccagagcggaaggcggagaggggcggtgccgagctgcgaggcgcgaagaagttctcggtgtcctcgtgccgagcgcggcctcgtccgggcgtctcccgcccgctggaacgggccagcggccgcctgcccctcgcgaggagcggcccggtctggaggagcgaggcggctcttgacgacctccagggtctccccgagccccagcacgcgaaacctggccctcggaagctggcggagcgcggccctcaggactcgggggacagggcggccagcccggccgggccgcgcaagagccctcaggaggcggccgccgcgcccggcacgagagagccctgcccagccgcccaggagccggccccgagtgaggacagaaaccccttccccgtcaagctccggtccacctccctctcgctcaaatacagggatggcgcctctcaggaggtgaagggtgtgaagaggtacagtgccgaggtccggttagaaaggtcgctgaccgtgctcccgaaggaggagaagtgtcccctcgggacggcccccgcccttcgaggcaccagggcccccagcgaccaaggaaaggggaaggcccggccccccgagccgctcagctccaagccgcccctgccccggaagccgcttctgcagagcttcacgctcccgcaccagcccgcgccccccgacgccggcccgggagagcgggaacccaggaaggagcccaggacggcggagaaaaggccgctgcgcaggggagctgaaaagagtctgccgcctgcagcaacagggcctggagctgatgggcagcctgcgccaccctggatcaccgtcactcggcagaagcggagggggaccttggaccagccacccaaccaggaagacaagcctggggcacggaccctgaagtctgaaccaggaaagcaagccaaggtgcccgagagaggccaggagcctgtgaagcaagctgactttgttcgcagcaagtctttcctgataacccctgtgaagcccgctgtggaccggaagcagggggcaaagctcaacttcaaggaggggctgcaaagaggaatctcattgtcccatcagaacttggctcagtctgcagtgatgatggagaaggaactgcatcagctgaagagagccagttatgccagtacagatcagccatcctggatggaacttgccagaaagaaatctcaagcttggagtgacatgccccagattataaaataggtgggcagtgtgctgataaagcatgtccactaccctgacaagccacttagttaaaaactgccagtgtattgtggcaaacaaactgtgaaacttaaagattgattttatcatcaagttatgacgaacttggggaagaggaaggaaccaggcaaaacaaagaggataaacacacagccatactcctgggccagagggcccagaaacaagaacaacattgaaaaagtccaggaaccagttcctgtgcccaaaggtacgaatgtgtcttttcgaattcccttgataaagaagcctcagacaaggaagaaaatagaaatgaaattggacacataaataggacacccagcaaaggccagaagagaagcccttctaggagaagggacatctgtgcttccagctgagatcagcccatgtctctggtcgctctcttgcctgtggatcctgtcttctttcatgtttactacgaggcatgacattcatggcaaaacagggatgccgtttccaagagcagctataaaacaatctgttttcctaaagacagccactctgagaaggagatgaaggaacacggcagggttcatcaattcatagactgtttccaaaaataatttttaaacttttccactaggcatctgtgtctttaaccactgcacaatgcattgcctgtttaataaaaggtttcaaacatg

SEQ ID NO: 145937 - DNA, 921 bp, Homo sapiens
  Payload ID: 8938
  Gene Symbol: KIAA1211L
  Gene Name: KIAA1211-like
  ENST ID: ENST00000428096
  CDS Start-End: 340-921
cgcgcctgcagctgggagctgggagctgggagcgcgccgggcgcagggccgggccggccgcgggagggtagtgtcagcgcccgcgtccagctcttcggccgcagacccgggctgtctggaggccgcgcggccacctgctgcgtcgccccggctttgggctggggctagacgcgcaccgcggcgggagcagccccggctcgccgcaccccgcggaaggtgcccttctctgcgcgtctcgccgagcccgggccacgctcctgtcccagcagaagtcactgattttctgcatactccatgtaatgaatctggtatgctgagataaggacacctgtgactgagatgatttctttggcgtccgtgcaagataaaagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggaggagtcgaggggcacgctgggcagccgggccctttctcacgacagtattttcattcctgagtccggacaggacgctactcggcctgtgcgggtgttttcccaagaaaatgtgtgtgatcggattaaagctctgcagttaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtcctggtaccaccataaag

SEQ ID NO: 145938 - DNA, 735 bp, Homo sapiens
  Payload ID: 8938
  Gene Symbol: KIAA1211L
  Gene Name: KIAA1211-like
  ENST ID: ENST00000415261
  CDS Start-End: 200-735
gtcgacaggctatccacaggctgtgggatgggagaaactgtggagccatccagctgtgtggccaggaaggatggctagcctctcccctgccagactactcactgcagggacagggcaggcatttgccagaagtcactgattttctgcatactccatgtaatgaatctggtatgctgagataaggacacctgtgactgagatgatttctttggcgtccgtgcaagataaaagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggaggagtcgaggggcacgctgggcagccgggccctttctcacgacagtattttcattcctgagtccggacaggacgctactcggcctgtgcgggtgttttcccaagaaaatgtgtgtgatcggattaaagctctgcagttaaaaatacagtgtaatgtgaaaatggggccaccacctcctccaggggggcttcctgccaagcggggagaggatgccggcatgagctctgaggacgacgggctgcccaggagcccccc

SEQ ID NO: 145939 - DNA, 1017 bp, Homo sapiens
  Payload ID: 8938
  Gene Symbol: KIAA1211L
  Gene Name: KIAA1211-like
  ENST ID: ENST00000423771
  CDS Start-End: 212-1017
tctgctgtgtgcctgtgcacccgcccaaggagctcacggggcacaggagggctgggcttggcagaagccccacttcctcctggcgcacgggtacttctgtgagagatggggacaagggctcttgatcagcaaccagtggtgacccgtgggccctaggccactcagaggaaagggaggcccactcttctccctgctgctagcttccaggaggatgagagagctggaggctcacagcacactcaggaggatggctgccttttaccagtgcatcaggcctgaccccagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggaggagtcgaggggcacgctgggcagccgggccctttctcacgacagtattttcattcctgagtccggacaggacgctactcggcctgtgcgggtgttttcccaagaaaatgtgtgtgatcggattaaagctctgcagttaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtcctggtaccaccataaaggtctctgtcgtgtctccagaccacgtgagcgacagcaccgtctctgcccggatctcagacaacagcctggcaccagtggctgacttcagttatcctgcagaatcctcctcctgcctggacaactctgcagctaagcacaagctccaggtcaagccccgcaaccagcggtcgagtaagatgag

SEQ ID NO: 145940 - DNA, 742 bp, Homo sapiens
  Payload ID: 8938
  Gene Symbol: KIAA1211L
  Gene Name: KIAA1211-like
  ENST ID: ENST00000420294
  CDS Start-End: 631-742
aggggagctgagcggcgtccgcccccgccgagccgagcggagccgagcgaagccggcgcgcctgcagctgggagctgggagctgggagcgcgccgggcgcagggccgggccggccgcgggagggtagtgtcagcgcccgcgtccagctcttcggccgcagacccgggctgtctggaggccgcgcggccacctgctgcgtcgccccggctttgggctggggctagacgcgcaccgcggcgggagcagccccggctcgccgcaccccgcggaaggtgcccttctctgcgcgtctcgccgagcccgggccacgctcctgtcccaggttttaactccatgattgtgtgctatgagtatatggctgcatgtctcaagaaattcactggctttaaaatgtgggcttagctactgccagtatgatttgatgaaagcggatagaggtctcagatccacccccggattccaccgtcaggcccaaggacggacccctggccattgactgatgccaagtgggtgcctggcagcagccttccttcccatccctgcttctggacgcctcagccaagtcactgattttctgcatactccatgtaatgaatctggtatgctgagataaggacacctgtgactgagatgatttctttggcgtccgtgcaagataaaagcgagcttgacatgatttccacaagggtgatggacattaagcttcgggaggctgcagaaggccttggggaggacagcacag

SEQ ID NO: 145941 - DNA, 3861 bp, Homo sapiens
  Payload ID: 8938
  Gene Symbol: KIAA1211L
  Gene Name: KIAA1211-like
  ENST ID: ENST00000612523
  CDS Start-End: 307-2127
gagcgaagccggcgcgcctgcagctgggagctgggagctgggagcgcgccgggcgcagggccgggccggccgcgggagggtagtgtcagcgcccgcgtccagctcttcggccgcagacccgggctgtctggaggccgcgcggccacctgctgcgtcgccccggctttgggctggggctagacgcgcaccgcggcgggagcagccccggctcgccgcaccccgcggaaggtgcccttctctgcgcgtctcgccgagcccgggccacgctcctgtcccagcgagcttgacatgatttccacaagggtgatggacattaagcttcgggaggctgcagaaggccttggggaggacagcacaggaaagaaaaaatctaaattcaaaacttttaagaagttttttgggaagaagaagagaaaagaatcgccgtcgtccacaggaagtagcacctggaaacaaagtcagacgaggaatgaggtcattgccatcgaatccgggccagtgggctacgactccgaggatgagctggaggagtcgaggggcacgctgggcagccgggccctttctcacgacagtattttcattcctgagtccggacaggacgctactcggcctgtgcgggtgttttcccaagaaaatgtgtgtgatcggattaaagctctgcagttaaaaatacagtgtaatgtgaaaatggggccaccacctcctccaggggggcttcctgccaagcggggagaggatgccggcatgagctctgaggacgacgggctgcccaggagccccccagagatgtctctgctgcacgacgtgggtcctggtaccaccataaaggtctctgtcgtgtctccagaccacgtgagcgacagcaccgtctctgcccggatctcagacaacagcctggcaccagtggctgacttcagttatcctgcagaatcctcctcctgcctggacaactctgcagctaagcacaagctccaggtcaagccccgcaaccagcggtcgagtaagatgaggcggctctcatcgcgcgctcagtctgaatccctgagcgacctgacgtgcaccccagaggaggaggaaaacgaggagaagccacttttggaagtcagcccagaagagcgccccagctctgggcagcaggacgtggcgccagacagaggccctgagcctgggccaccggcgcccttgccgccacccggaggggcccgtgccagacgcgcccgcctgcagcactcctccgcgctcacggccagcgtggaggaggggggcgtccccggggaggacccctcaagccgcccggccaccccggagctcgccgagcccgagtcggcccccactctccgcgtggagcccccgtccccgccggagggccccccgaatcccggtcccgacggcggaaagcaggatggggaggcgccccccgcaggcccgtgtgccccggccacggacaaggcggaggaggtggtctgtgctcccgaagacgtcgcgagcccgtttcccaccgccatccctgagggggacacgactccccccgagactgaccccgccgccacctcagaggcgccctctgctcgcgacgggccagaacgcagtgtcccgaaggaagcggagccgacgccgcccgtgctcccggatgaggagaaggggcccccagggccggcgcctgagcccgagagagaagcggagacggagcccgagagaggagcggggaccgagcccgagagaattgggaccgagccctccacggcgcccgccccgagcccgccggcgcccaagagctgcctgaaacaccggcccgcggccgccagcgagggccgccgcgtccccgccgcttgccgctgcggagtctcccccggtggagcccggccccggttccctcgacgcagaggccgccgccccggagcgccccaaggccgagcgagccgaggcgccaccggcgggcgccgagagggcggcgccagagcggaaggcggagaggggcggtgccgagctgcgaggcgcgaagaagttctcggtgtcctcgtgccgagcgcggcctcgtccgggcgtctcccgcccgctggaacgggccagcggccgcctgcccctcgcgaggagcggcccggtctggaggagcgaggcggctcttgacgacctccagggtctccccgagccccagcacgcgaaacctggccctcggaagctggcggagcgcggccctcaggactcgggggacagggcggccagcccggccgggccgcgcaagagccctcaggaggcggccgccgcgcccggcacgagagagccctgcccagccgcccaggagccggccccgagtgaggacagaaaccccttccccgtcaagctccggtccacctccctctcgctcaaatacagggatggcgcctctcaggaggtgaagggtgtgaagaggtacagtgccgaggtccggttagaaaggtcgctgaccgtgctcccgaaggaggagaagtgtcccctcgggacggcccccgcccttcgaggcaccagggcccccagcgaccaaggaaaggggaaggcccggccccccgagccgctcagctccaagccgcccctgccccggaagccgcttctgcagagcttcacgctcccgcaccagcccgcgccccccgacgccggcccgggagagcgggaacccaggaaggagcccaggacggcggagaaaaggccgctgcgcaggggagctgaaaagagtctgccgcctgcagcaacagggcctggagctgatgggcagcctgcgccaccctggatcaccgtcactcggcagaagcggagggggaccttggaccagccacccaaccaggaagacaagcctggggcacggaccctgaagtctgaaccaggaaagcaagccaaggtgcccgagagaggccaggagcctgtgaagcaagctgactttgttcgcagcaagtctttcctgataacccctgtgaagcccgctgtggaccggaagcagggggcaaagctcaacttcaaggaggggctgcaaagaggaatctcattgtcccatcagaacttggctcagtctgcagtgatgatggagaaggaactgcatcagctgaagagagccagttatgccagtacagatcagccatcctggatggaacttgccagaaagaaatctcaagcttggagtgacatgccccagattataaaataggtgggcagtgtgctgataaagcatgtccactaccctgacaagccacttagttaaaaactgccagtgtattgtggcaaacaaactgtgaaacttaaagattgattttatcatcaagttatgacgaacttggggaagaggaaggaaccaggcaaaacaaagaggataaacacacagccatactcctgggccagagggcccagaaacaagaacaacattgaaaaagtccaggaaccagttcctgtgcccaaaggtacgaatgtgtcttttcgaattcccttgataaagaagcctcagacaaggaagaaaatagaaatgaaattggacacataaataggacacccagcaaaggccagaagagaagcccttctaggagaagggacatctgtgcttccagctgagatcagcccatgtctctggtcgctctcttgcctgtggatcctgtcttctttcatgtttactacgaggcatgacattcatggcaaaacagggatgccgtttccaagagcagctataaaacaatctgttttcctaaagacagccactctgagaaggagatgaaggaacacggcagggttcatcaattcatagactgtttccaaaaataatttttaaacttttccactaggcatctgtgtctttaaccactgcacaatgcattgcctgtttaataaaaggtttcaaacatg

SEQ ID NO: 145942 - DNA, 3281 bp, Homo sapiens
  Payload ID: 8939
  Gene Symbol: KIAA1217
  Gene Name: KIAA1217
  Uniprot ID: Q5T5P2
  ENST ID: ENST00000307544
  CDS Start-End: 333-3131
acacatggaagaaacatttctcgttagttcagcattggttttagttatgctgatttccgggacaggaaaaatgccttcctactcagaattaactttcatagagtagaaacaaaacctctgaatgtccgtgaaatagttttaacaagagtggatactgctcctttaaaccacatattttgactaaaagcttccttctgtaaaaaacccaaggcttgcatttagtcaccatgaagacaggcaaagctgaaagcattggagagaggggtggtttcgaggtctctgcaagtctagaaagtttcttctagaaaagaaaggctcacggaaaatgtaagatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttt

SEQ ID NO: 145943 - DNA, 7383 bp, Homo sapiens
  Payload ID: 8939
  Gene Symbol: KIAA1217
  Gene Name: KIAA1217
  Uniprot ID: Q5T5P2
  ENST ID: ENST00000376451
  CDS Start-End: 261-4658
atgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 145944 - DNA, 6052 bp, Homo sapiens
  Payload ID: 8939
  Gene Symbol: KIAA1217
  Gene Name: KIAA1217
  Uniprot ID: Q5T5P2
  ENST ID: ENST00000376452
  CDS Start-End: 404-4528
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 145945 - DNA, 7381 bp, Homo sapiens
  Payload ID: 8939
  Gene Symbol: KIAA1217
  Gene Name: KIAA1217
  Uniprot ID: Q5T5P2
  ENST ID: ENST00000376454
  CDS Start-End: 31-5862
agcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaactcgccgctctcactcaagccattcgcaccggaactaaaacagggaagaagactttgcaagtggtagtctatgaagaagaggaagaggatggcaccctgaaacagcacaaagaagccaagcgcttcgaaatcgctaggtctcaacctgaagacacccctgaaaacacagtgaggaggcaagagcagcccagcatcgagagtacatctccgatttcaagaactgatgaaattagaaaaaacacctacagaacattggatagcctggagcagaccattaaacagctcgaaaatacaatcagtgaaatgagtcccaaagccctagttgatacctcatgttcttccaacagagattctgttgcaagttcatcccacatagcccaagaggcctctccccgacccttgctagttccggatgaaggtcccactgccctagagccccctacgtcgataccttcagcttcacgtaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 145946 - DNA, 3203 bp, Homo sapiens
  Payload ID: 8939
  Gene Symbol: KIAA1217
  Gene Name: KIAA1217
  ENST ID: ENST00000376456
  CDS Start-End: 404-3203
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcag

SEQ ID NO: 145947 - DNA, 6123 bp, Homo sapiens
  Payload ID: 8939
  Gene Symbol: KIAA1217
  Gene Name: KIAA1217
  Uniprot ID: Q5T5P2
  ENST ID: ENST00000376462
  CDS Start-End: 810-4604
ggagagggctgcgcgcttctcgccaagcaagcgggaggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaaacggagatcctggggtcctaaatttgtggccgattgcactgtgtcctggagacggagtggaaccacagcccagagcccctgggaatcatccctgaaagactgcattacttctccatggagtcttcctcctcctgcttattttctttttggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 145948 - DNA, 5706 bp, Homo sapiens
  Payload ID: 8939
  Gene Symbol: KIAA1217
  Gene Name: KIAA1217
  Uniprot ID: Q5T5P2
  ENST ID: ENST00000396445
  CDS Start-End: 261-2981
atgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtgactccaaactccaaattttaactgttaacacacggtgccagaccaggtggcttttctttggtgaatgtagtgtttcatctgaacacctcgggaagcagagacaaaccaacctgtggttgaactgcccttaacgtcaccactactaacgtctatgttgactgtattgtgttagaagcacattaacactccgtcacaatgcccgacccccaccccagtaattatccagacgcatggcccacctggcacacaggaaatggtagagctggaatgatgggactcctctcacaaatgtattcttcctttcctcctttcccgtccatcctttgctatgtacatggggggtttctaccaggtccagtagagcacaacaagacttagctcaggccttgaactgtgtttggttggttttctttgattgaattattctcagaagggctgtgttgccaggccctgtgggttgatcatgtgaccgcctttctgacaaaatgtctcccgccatctttatttgcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatca

SEQ ID NO: 145949 - DNA, 3059 bp, Homo sapiens
  Payload ID: 8939
  Gene Symbol: KIAA1217
  Gene Name: KIAA1217
  Uniprot ID: Q5T5P2
  ENST ID: ENST00000396446
  CDS Start-End: 261-2861
atgccagtgtcagcttctctccgaaaactgggtaatacgaaatggtctttattggttgtgaacactcgagctgagaaacattttaggatctttgtgtcttttgtgatgattttgtttctgaagaggaagctgtctaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggtagttttaccttaaacccacttttggatggacgctatttcagttaagcaagtcactgacttagtttataccaaatattgtgctttctttgtaagataacggtttacatagacatcctggatctgggggcatgaagaaagtctaaataaacctttgttacacttttttaccacgcttttgcatgcttgcaataaaacatcttttactttgtga

SEQ ID NO: 145950 - DNA, 5962 bp, Homo sapiens
  Payload ID: 8939
  Gene Symbol: KIAA1217
  Gene Name: KIAA1217
  Uniprot ID: Q5T5P2
  ENST ID: ENST00000430453
  CDS Start-End: 644-4438
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 145951 - DNA, 5977 bp, Homo sapiens
  Payload ID: 8939
  Gene Symbol: KIAA1217
  Gene Name: KIAA1217
  Uniprot ID: Q5T5P2
  ENST ID: ENST00000458595
  CDS Start-End: 404-4453
agagcctcggtggtttgcagcagtggaaccaggcaggcccagttgtgggtaggagaggccgtcacctgttgaggcctcccccccacacccccgcatcgccctgccctggcagagcccagcccccagtccccggagagcgcgcctgaggacggacggacggacggacggacagacctagggacggagggccaggggcaggggagatccaagaggccccgcgctggaatgcagttttctcgggcgagggagactttgcaccggagtggaaaatagtttggggtggggtttcgcaccgtcccctcctccccagccccgggccccctcccaggcgctttctgggagcttttagaactgcgctctgaagtttccagagagcgaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 145952 - DNA, 2589 bp, Homo sapiens
  Payload ID: 8939
  Gene Symbol: KIAA1217
  Gene Name: KIAA1217
  ENST ID: ENST00000438429
  CDS Start-End: 240-2589
aaaagaaaacagcccagacatggaggggggttttacctgacagctccgaaggaagaccctggagtccgttccagacaaaaacttccagaagaattagattttctgctttaactgccgcctcacctgtggagctctgggtacagacaaggagccccaaactgtctcacagtcctcaaccacccagtctgggtgacccggtcgagcatttatcagagacgtccgctgattctttggaagccatgtctgagggggatgctccaacccctttttccagaggcagccggactcgtgcgagccttcctgtggtgaggtcaaccaaccagacgaaagaaagatctctgggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcag

SEQ ID NO: 145953 - DNA, 568 bp, Homo sapiens
  Payload ID: 8939
  Gene Symbol: KIAA1217
  Gene Name: KIAA1217
  ENST ID: ENST00000635504
  CDS Start-End: 28-568
gaggagcttttgcggcaggcagagacaatggaagaaaatgaaagccagaaatgtgagccgtgccttccttactcagcagacagaagacagatgcaggaacaaggcaaaggcaatctgcatgtaacatcaccagaagatgcagaatgccgcagaaccaaggaacgcctttctaatggaaacagtcgtggttcagtttccaagtcttcccgcaatatcccaaggagacacaccctaggggggccccgaagttccaaggaaatactgggaatgcaaacatctgagatggatcggaagagagaagcgttcctagaacatctgaagcagaagtacccccaccacgcctctgcaatcatgggtcaccaagagaggctgagagaccaggctttgaagggcatgctgatctctcttcaggcagaacttgacattcaaagacaaggagccccaaactgtctcacagtcctcaaccacccagtctgggtgacccggtcgagcatttatcagagacgtccgctgattctttggaagccatgtctgagggggatgctccaacccctttttccagaggcag

SEQ ID NO: 145954 - DNA, 1358 bp, Homo sapiens
  Payload ID: 8939
  Gene Symbol: KIAA1217
  Gene Name: KIAA1217
  ENST ID: ENST00000635163
  CDS Start-End: 1-1358
gagacaaaataatggcagaactccaggcattccagaagtgttcctttatggatgtaaattcaaacagtcatgctgagccatcccgggctgacagtcacgttaaagacactaggtcgggcgccacagtgccacccaaggagaagaagggcatttttggcagttggagaacaaagcaatccaagaatttggaatttttccatgaagatgtacggaaatctgatgttgaatatgaaaatggcccccaaatggaattccaaaaggttaccacaggggctgtaagacctagtgaccctcctaagtgggaaagaggaatggagaatagtatttctgatgcatcaagaacatcagaatataaaactgagatcataatgaaggaaaattccatatccaatatgagtttactcagagacagtagaaactattcccaggaaactgtgcctaaggccagtttcggtttctctggcattagtccattagaagatgaaataaacaaagggtctaaaatctcaggcctgcaatactctatacctgacaccgagaaccagacgctgaattacggaaagacaaaggagatggaaaagcaaaatacggataagtgtcacgtttcctctcacactagactaacagaatcaagcgtgcatgattttaaaacagaagatcaagaggttatcacgacagattttggccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctataagagactttcaactatctttgaggaatgtgatgaggaattagagagaatgatgatggaggaaaagatagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaag

SEQ ID NO: 145955 - DNA, 6034 bp, Homo sapiens
  Payload ID: 8940
  Gene Symbol: KIAA1257
  Gene Name: KIAA1257
  Uniprot ID: Q9ULG3
  ENST ID: ENST00000265068
  CDS Start-End: 169-1398
gggcctgcggccctccctgcaccggcggacgctcctctcagtcttggagtctcttcgcccaggtggctgtggatccggtacgggagttgccgccgcggtccaactccccgctgccgcccagcgcatccgctcgcaggagcgccggcggccagcagtgcgctctgcagcatgtcgctacatgcctgggagtgggaagaggaccccgcaagcatagagcccatctcctccatcactagcttttaccagtccacgagcgagtgtgacgtggaggaacacctgaaggccaaggccagggcccaggagtctgactctgaccgcccgtgcagcagcatcgagtcctcatctgagcctgccagcactttcagctccgacgtgccccacgtggtcccctgcaaattcaccatctcactggccttccctgtgaatatgggtcagaagggaaaatatgcaagtttgattgaaaaatataagaaacaccctaaaacagacagttctgttacaaagatgcgtcgtttttaccacattgagtatttccttctgccggacgatgaagaacctaaaaaagttgacatattgctatttccaatggtggccaaagtattcctggagtcaggagtaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccggtacccactgcttgccctgttcccagcagctcctgcttgtcttgtggccagaacggccataagcggatgctcctaatgacaaccctgctgcgtgccacctcatttcatcctcacagccacctcaggaaactcaggggaattggcttcatagtacagggggaaacaaaggcccagagagggtagctaccttgcctgagatcacacagctaggaaatgtgaagcctggacttgaacccagctctgtttgattccaaaatccaaggaagcctatgggaatattaaatgtcatcattgtgtttgttaagaagatgctgcttttaataaatgctttcctacagatttttacaaaaacatctagtaaagggaatgaggaaagggaaccctttttgactgagcccctctgggtgcaggcacttcccgtgtgacacatcacttacttctcagaccaaattctgacccactcagccaacctgtggtgtggtggtggctgtggtggttatcatagttaccatttttttcagtgaggaaaagaactcaaagaggttaagtaactttcctaatcccacacagctcagtggccaaacagggatttaattattttgctttataagatctaccacaatttatgaactggactttatacatactggtaaatcataactaaatattatatcaatatgttttgatgattgaaagctcagcatatattttggtaaaattatgttgctttgttccaaaaaagagtaatatggggtgaactccccccctttttttttctttttagagaaaattcagactttgttcgtttttttgccatcacgtgtcttgtgcgccctctcctggctactctgcagaagcgcgtgcgttggtcttttctgagctggaaccagcattcatagagaagggggcaaaaaccccgtaagtcagagcctccagttcagttccacaggtgccagtcgtcatcctcctctcgcgctcttgggttggtgtcaattcagtttgagaaagtgctattaacttttcagtttgcactttttttttttttgagatagggtcttgctctctcacccaggctggagtgtaagtgacatgatcatagctcactccagcctgaagcaagcctcccgcctctgccacccgcatagctaagactacaggtgcacaccaccacacctggctattttttttattttctgtagagacaaggtcttgctatgttgcccaggctggtctcaaactcctggtcacaagtaatcctcctgcttcagcctctcagagttctagaattacaggcatgagctgccgcatttggcagtttgcagttttaaatgactttttgaaaatgatacttcacctacagcttgtccttcctgatcaccttcactttctcgtagcatcagaacctcttgagaggcaacagtgacagagagtaaactttcagagggtcttaccccaccccacgctccagcctgaccctccagcatacctattgcacacagtagctttgagcgaacgcctttgctagctgcttccttcgtcctacagtcccaaggaggaacccatgatcctcctgggggagcgtaccatgggacctgccccgctttggattttactgtgagaggaaaaagaagttcaaccatttgggcctgcctggcatgactgtttccagcagaatgaagccaggacatggtcccctctctcttttttttttttcgagatggagtcttgctctgtcgcccaggctggagtgcagtggcgcgatctcggctcactacagcctctgcccccccaggtttaagcaattctcctgcttcaacctctagagtagctgggattacaggcgcatgccaccatgccaggctaatttttgtattttttgtagagatggggtttcacaattttggccaggctggtcttgaactcctgacctcgtgattgtcttacatgtccgtgtgaagagaccaaacaggctttgtgtaagtaacaaggctgtttatttcacctgggtgcaggcaggctgagtctgaaaagagagtcagcaaagggtggtgggattatcattagttcttacaggttttgggataggcagtggagttaagagcaatgttttgggggcagggggtggatctcacaaagtacattctcaagggtggggagaattacaaaaaaaccttcttaagggtgggggagattataaagaaccttcttaagtgtgggggagattacaaagtacattgatagttagggtggggcagaaacaaatcacaatggtggaatgtcatcagttaaggctattttcacttcttttgtggatcttcagttgcttcaggccatctggatgtatacatgcaggtcactggggatatgatggcttagcttgggctcagaggcctgacagtgatccacctgcctcagcctcccaaagtgctgggattacaggcgtgagctaccgcactggacctagcctcccctctctataacctgccccgtcatgtacaatgctgtacagtgcaggggttcacatgtaagaactttggtgaccaaaacactttgatcatggctcagccacttaccagcaagttacctactttctctgagtctcactttcctcctctgtgaaatgggggtgattactcctacctcagagcgttgttttaaggatcacaggagctgacgtgtgtaaactgctagcacagtgggacccagggggtgcaggtgtggaggcagcagctgtcctgaggccatgtgtgtgggccgctccattatacccatgacatagcctatggtcatcgacagagaacgggtcagctcagcaggccagttgtatgtctggttttgccagaaactaatagcataagattatttactgtaagcccagcataattatttttggtaatcatcttcaatttcaaattaggccatagatcatgtatgtataccttattagtaaatattggttggctagtaacccagtaagattctagaaagattctgtgtctgggaatgagctcttattttaaaaggatagtattgcatagcggaggggccccacttagcccaacagaactggtttggatgctggttctacaacgtattttctaagagaccttggatgattgcgtcagaactctgggcctcatttcccccatctgtaatgtggagatgacagcaaccacacaaggttaaggatgaaatgacattagcgcatgtttgggactggctgttggaggagcacaaacattcccttacaccattccactcttaaccagggctcttaactcagggggcttgtgtctgctggggacacttggctgtgtgtggaggcattttggttggcacgactgagagtgggatgccactggcatctagtaagatactgttaaacatgccataatgcacaggactgtcccctgagcaaagaatggtctgccccaactgtcagcagtgtggaggctgtgagcccgcagcctggaattctgttctggtgtatgtctccctgactctgatgatttgagcactttttttttatttttatttttgcaatggggattccttctaccttgagtagtcttttttttttttttgagacggagttttgctcttgttgcccaggctggagtacaatggcgcgatctcagctcaccgcaacctccgcctcccgggttcaagcgattctcctgcattagccttcctgagtagttgggaatacaggcatgcgctaccacgtccggctgattttgtatttttggtagagacgaggtttctccattttggtcaggctggtctcaaactcccgacttcaggtgatccgcctgcctcggcctgccaaactgctgggattataggcgtgagccaccgtacccggcctacccttgggtagtctttcatgtgaaaaggctcacaaaattatagaacacaggcgtaatgggtgacagcttttatgaatcagctttgttaaagaggatcctgcgggagcatgagggctacccccaggagctgtgcacgcctctgttcacagcctgtgcagatggctgtgcacacctggcccgggacttgttttagaagtgcctactctttctgaatgtgagcgacttggcttttacatgccctagaaatacatttacaggcatgttgaaaggaatagactgatctttttgagcaccatctcatatatcatctttcttaatcctttaaacccaaggaaggtggtgtctatccccattttgaagatgaaattgagccttggagactctagcttatcacatgacaaagagtcagatctgggattcaaacccaggtcaatcctgcctccaaaacttgaggtgattttttttgtttatttgttttgttttttccttacctagtacatctctgactggtgaaatacatggataccttttatagaaaaagcattctgggctgggtgtggtggctcacgcctgtaatccctacactttgggaggccgaggcgggtggatcacgaggtcaggagatcgagaacagcctggctaacacggtgaaaccccgtctttactaacaatacaaaaaattagccaggcatgttgtcgggcacctgtagtcccagctacttgggaggctgaggcaggagaatggcgtgaacccaggaggcgtagctagcagtgagccaagaccgtgccactgtactccagcctgggcagcagagcaagactctgtctc

SEQ ID NO: 145956 - DNA, 1632 bp, Homo sapiens
  Payload ID: 8940
  Gene Symbol: KIAA1257
  Gene Name: KIAA1257
  Uniprot ID: Q9ULG3
  ENST ID: ENST00000515659
  CDS Start-End: 494-1387
acaagtagtacttcacatcttgatagaccttgctttgttttgttttcatctgcttacttgaactagcccaccattatgatttcaacttctcctggtattctgtcgatggtgtaagtttcttgtatgggttggaaccccgagagcgcaccaacagacaacacgaggcggtgtggagcaacatgctgtttcaatgaacgccttggtgcaggccggctgaggcctaaaatggcgtcagccccaagtgaggacggggcaaaggttttatagtctcctgtaaacaggaagtgtcctagtctggcgtaactgctacgctgtacccggatggcctctttctcatcttcatgtcttccggccagggtaggtgtattccagccggctctcctcctgcttctgctattttgctggtgcacgctgctgacgtcagaagggaaaatatgcaagtttgattgaaaaatataagaaacaccctaaaacagacagttctgttacaaagatgcgtcgtttttaccacattgagtatttccttctgccggacgatgaagaacctaaaaaagttgacatattgctatttccaatggtggccaaagtattcctggagtcaggagtaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccggtacccactgcttgccctgttcccagcagctcctgcttgtcttgtggccagaacggccataagcggatgctcctaatgacaaccctgctgcgtgccacctcatttcatcctcacagccacctcaggaaactcaggggaattggcttcatagtacagggggaaacaaaggcccagagagggtagctaccttgcctgagatcacacagctaggaaatgtgaagcctggacttgaacccagctctgtttgattccaaaatccaaggaagcctatgggaatattaaatgtcatcattgtgtttgttaagaa

SEQ ID NO: 145957 - DNA, 2408 bp, Homo sapiens
  Payload ID: 8940
  Gene Symbol: KIAA1257
  Gene Name: KIAA1257
  ENST ID: ENST00000511438
  CDS Start-End: 773-1975
agtcttggagtctcttcgcccaggtggctgtggatccggtacgggagttgccgccgcggtccaactccccgctgccgcccagcgcatccgctcgcaggtaccgccagcacctggaggggaaccccgacccctgcccccacctcggccgccgcagcccgggactcttcccgcctcgcctcgatgcgtgttccctcttcggcgtttgcccggcgttccgcctccatgggcctgagctgatgccccgagcccagcacccagtgcacattcatgttctgtcttggggacagggcttgccctccccgacctcgccaggctcctgcacgtgctgcccccggcctggtttgcctctccccaaatagcaaacgcatcttgtgcttaggcgcagcaggcctgcctgagcagacgtcccctctcccgcctggtggctcccgggagctgctcacctggggcaggcattccagaagcccggcgactgactcctggttaggcgaaggaaacggggttgctcgtcgtcgtgcttactgccagccacccttatctgttgttccttcatccattcattctctaagtcgattgagtaccgactgtgtggcaggcagtgaaggagccccggcgttcatctaggagcaggcgggggaagcagggaagagaagggtgggtgcttctgcaggaggccgggcttacctcctggagcagccctggaatacaggcggggacagccttcactttctccctgccaggagcgccggcggccagcagtgcgctctgcagcatgtcgctacatgcctgggagtgggaagaggaccccgcaagcatagagcccatctcctccatcactagcttttaccagtccacgagcgagtgtgacgtggaggaacacctgaaggccaaggccagggcccaggagtctgactctgaccgcccgtgcagcagcatcgagtcctcatctgagcctgccagcactttcagctccgacgtgccccacgtggtcccctgcaaattcaccatctcactggccttccctgtgaatatgggtcagaagggaaaatatgcaagtttgattgaaaaatataagaaacaccctaaaacagacagttctgttacaaagatgcgtcgtttttaccacattgagtatttccttctgccggacgatgaagaacctaaaaaagttgacatattgctatttccaatggtggccaaagtattcctggagtcaggagtaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccgtcaggaagaagaaagggaacagccccatctcctgagcagcacagaccctcccacggccaccgcatggtgaacctgcacagcctcccccacacccgaccacaccctcctcaacaatcaacttcattaaagtgcagcaggacagatggcagcagccaggccctgtgtgaggctgggctgggctcacctcgtggtcgtggttgcggagcccaatgcggatggagcggctggcccgcgacagcacggccgtcatgccatacaggttgatgaggatgttggccacccgcttcagtaccagctgctcctccatgatggtctgggatcacagaggctccaagtggggactcactacctagaccagtcccccacatggtccctccctgggctgcatctttgcctgtcttagtctcctgtgttccttgagaaagtggagtcaataacacctttctcttcaggttgtgggagaacggc

SEQ ID NO: 145958 - DNA, 3442 bp, Homo sapiens
  Payload ID: 8941
  Gene Symbol: KIAA1324
  Gene Name: KIAA1324
  Uniprot ID: Q6UXG2
  ENST ID: ENST00000369939
  CDS Start-End: 184-3225
agaggacagagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgccaccagtgtgaccctgacaaatactcagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaa

SEQ ID NO: 145959 - DNA, 2782 bp, Homo sapiens
  Payload ID: 8941
  Gene Symbol: KIAA1324
  Gene Name: KIAA1324
  ENST ID: ENST00000457623
  CDS Start-End: 78-2782
tttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaagga

SEQ ID NO: 145960 - DNA, 564 bp, Homo sapiens
  Payload ID: 8941
  Gene Symbol: KIAA1324
  Gene Name: KIAA1324
  ENST ID: ENST00000533147
  CDS Start-End: 291-564
ttctttctctcggttcacacgccacgtgtgcaacatcggagatgctcataaaataacccctggcccgaaagggcagtagaaaacggaaatttgttggctggcttggaggatgcttccactgtgttcttcacacgagccccgggcctgcctgttgggccggttgcgcaccccgggcgcgcgctctcccgcgcccacgccgcgcgcaccagcggcggcggctgccatggcgacccgcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgct

SEQ ID NO: 145961 - DNA, 750 bp, Homo sapiens
  Payload ID: 8941
  Gene Symbol: KIAA1324
  Gene Name: KIAA1324
  ENST ID: ENST00000531664
  CDS Start-End: 136-750
cgcaggtgagctgcagaggcgcgcgtggtccctgccccacccgcgcggagccagagaggaggcggttgtcaaggcgacgtggaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttc

SEQ ID NO: 145962 - DNA, 3186 bp, Homo sapiens
  Payload ID: 8941
  Gene Symbol: KIAA1324
  Gene Name: KIAA1324
  ENST ID: ENST00000527996
  CDS Start-End: 16-204
actcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgccaccagtgtgaccctgacaaatactcagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagcagccagctcctgtcaccatctctctttcagaggactcctgatggatttgactcagtgccgctgaagacatcctcaggaggcctagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaatt

SEQ ID NO: 145963 - DNA, 570 bp, Homo sapiens
  Payload ID: 8941
  Gene Symbol: KIAA1324
  Gene Name: KIAA1324
  ENST ID: ENST00000534476
  CDS Start-End: 114-570
gcgcgcgtggtccctgccccacccgcgcggagccagagaggaggcggttgtcaaggcgacaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccggga

SEQ ID NO: 145964 - DNA, 492 bp, Homo sapiens
  Payload ID: 8941
  Gene Symbol: KIAA1324
  Gene Name: KIAA1324
  ENST ID: ENST00000527501
  CDS Start-End: 1-249
atcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaaggtgtctgggtccagtcctttgggagctgaatcatagttcagtctcagctgttccccactgagcaattctgagctgggagggctggctttgtgtgggtggaggactcctgatggatttgactcagtgccgctgaagacatcctcaggaggcctagacatggacctgtgagaggcactgcctgcctcacctgcctcctcaccttgcatagcacctttgcaagcctgcggcgatttgggtgccagcatcctgcaacacccactgctggaaatctcttcattg

SEQ ID NO: 145965 - DNA, 2903 bp, Homo sapiens
  Payload ID: 8941
  Gene Symbol: KIAA1324
  Gene Name: KIAA1324
  Uniprot ID: Q6UXG2
  ENST ID: ENST00000529753
  CDS Start-End: 30-2810
cgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctgacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtgagaggcactgcctgcctcacctgcctcctcaccttgcatagcacctttgcaagcctgcggcgatttgggtgccagcatcctgcaacacccactg

SEQ ID NO: 145966 - DNA, 553 bp, Homo sapiens
  Payload ID: 8941
  Gene Symbol: KIAA1324
  Gene Name: KIAA1324
  ENST ID: ENST00000526264
  CDS Start-End: 87-553
agagaggaggcggttgtcaaggcgacgtggcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttc

SEQ ID NO: 145967 - DNA, 3073 bp, Homo sapiens
  Payload ID: 8942
  Gene Symbol: KIAA1324L
  Gene Name: KIAA1324-like
  ENST ID: ENST00000394714
  CDS Start-End: 1-256
ctcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgacagctccttaaatgcttgaaggcaattaccaggtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggt

SEQ ID NO: 145968 - DNA, 563 bp, Homo sapiens
  Payload ID: 8942
  Gene Symbol: KIAA1324L
  Gene Name: KIAA1324-like
  ENST ID: ENST00000398276
  CDS Start-End: 228-563
acacagtgagggaggcaaaacagtgtggatgcagcagaataaccacaaccaggattttgaactgaataagtaagaaagattatcactttgaatatacggaatgtgatagcagtggctccaggtggagagttgccattccaaattctgcagtggactgctctggcctgcctgacccagtgagaggcaaagaatgcactttctcctgtgcttctggagagtatctagaaatgaagaaccaggtatgcagtaagtgtggtgaaggcacctattccttgggcagtggcatcaaatttgatgaatgggatgaattgccggcaggattttctaacatcgcaacattcatggacactgtggtgggcccttctgacagcaggccagacggctgtaacaactcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggag

SEQ ID NO: 145969 - DNA, 567 bp, Homo sapiens
  Payload ID: 8942
  Gene Symbol: KIAA1324L
  Gene Name: KIAA1324-like
  ENST ID: ENST00000427812
  CDS Start-End: 1-239
aagaaaatcagagtttgcactatgactttagcaacctcagcagtgtgggctcattaatgaatggccccagcttcacctccaaaggaacaaaatacttccatttcttcaatatcagtttatgtgggcatgagaagaaaaagactttcaagaggaagcttgtccaaaataaaaaggagacatgcagggccaaatatcagttgataaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatc

SEQ ID NO: 145970 - DNA, 3527 bp, Homo sapiens
  Payload ID: 8942
  Gene Symbol: KIAA1324L
  Gene Name: KIAA1324-like
  ENST ID: ENST00000444627
  CDS Start-End: 119-2995
cagcgggtgacggagcggcgagacgagcgcacagcagtcgcggcccgggagccggagctgccgccgcaccccgggaaggctgccttgccgccggcccgccgaccgcggccggacgaagatgctgttccgcgcccgggggccggtacggggcaggggctgggggcggccggcggaggctccccgccgcgggcgctcgccgccctggagccccgcctggatttgctgctgggcgctcgccggctgccaggcggcctgggctggggacctgccctcctcctccagccgcccgcttcctccttgccaggagaaagattatcactttgaatatacggaatgtgatagcagtggctccaggtggagagttgccattccaaattctgcagtggactgctctggcctgcctgacccagtgagaggcaaagaatgcactttctcctgtgcttctggagagtatctagaaatgaagaaccaggtatgcagtaagtgtggtgaaggcacctattccttgggcagtggcatcaaatttgatgaatgggatgaattgccggcaggattttctaacatcgcaacattcatggacactgtggtgggcccttctgacagcaggccagacggctgtaacaactcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagatgccactacattgagaaagaaaccaaccagtgcaaggaatgtccacctgacacctacctgtccatacatcaggtctatggcaaagaggcttgtattccatgcgggcctgggagtaaaaacaatcagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacaataa

SEQ ID NO: 145971 - DNA, 3179 bp, Homo sapiens
  Payload ID: 8942
  Gene Symbol: KIAA1324L
  Gene Name: KIAA1324-like
  Uniprot ID: A8MWY0
  ENST ID: ENST00000416314
  CDS Start-End: 197-2785
tcattgacacagtgagggaggcaaaacagtgtggatgcagcagaataaccacaaccaggattttgaactgaataagtaagaaagattatcactttgaatatacggaatgtgatagcagtggctccaggtggagagttgccattccaaattctgcagtggactgctctggcctgcctgacccagtgagaggcaaagaatgcactcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcatta

SEQ ID NO: 145972 - DNA, 2911 bp, Homo sapiens
  Payload ID: 8942
  Gene Symbol: KIAA1324L
  Gene Name: KIAA1324-like
  ENST ID: ENST00000423294
  CDS Start-End: 1-2911
agatgctgttccgcgcccgggggccggtacggggcaggggctgggggcggccggcggaggctccccgccgcgggcgctcgccgccctggagccccgcctggatttgctgctgggcgctcgccggctgccaggcggcctgggctggggacctgccctcctcctccagccgcccgcttcctccttgccaggagctttctcctgtgcttctggagagtatctagaaatgaagaaccaggtatgcagtaagtgtggtgaaggcacctattccttgggcagtggcatcaaatttgatgaatgggatgaattgccggcaggattttctaacatcgcaacattcatggacactgtggtgggcccttctgacagcaggccagacggctgtaacaactcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaag

SEQ ID NO: 145973 - DNA, 576 bp, Homo sapiens
  Payload ID: 8942
  Gene Symbol: KIAA1324L
  Gene Name: KIAA1324-like
  ENST ID: ENST00000425689
  CDS Start-End: 316-576
gtgctatgcagagaaggtcaaagacaatggccttctcattcctgatgtccgcatggtgatgtggcttgatgtttctattctcacttgtcattgacacagtgagggaggcaaaacagtgtggatgcagcagaataaccacaaccaggattttgaactgaataaaaagattatcactttgaatatacggaatgtgatagcagtggctccaggtggagagttgccattccaaattctgcagtggactgctctggcctgcctgacccagtgagaggcaaagaatgcactttctcctgtgcttctggagagtatctagaaatgaagaaccaggtatgcagtaagtgtggtgaaggcacctattccttgggcagtggcatcaaatttgatgaatgggatgaattgccggcaggattttctaacatcgcaacattcatggacactgtggtgggcccttctgacagcaggccagacggctgtaacaactcttcttggatccctcgtggaaactacatagaatctaatcgtgatgactgcacggtgtctttgatctatgctgtgcaccttaagaagtcaggctat

SEQ ID NO: 145974 - DNA, 6841 bp, Homo sapiens
  Payload ID: 8942
  Gene Symbol: KIAA1324L
  Gene Name: KIAA1324-like
  Uniprot ID: A8MWY0
  ENST ID: ENST00000450689
  CDS Start-End: 187-3276
cgtgacgggagcatcggcgctggctgcccgggccgcgagcgcagcagagctgtcagcgggcggacgggcagcgggtgacggagcggcgagacgagcgcacagcagtcgcggcccgggagccggagctgccgccgcaccccgggaaggctgccttgccgccggcccgccgaccgcggccggacgaagatgctgttccgcgcccgggggccggtacggggcaggggctgggggcggccggcggaggctccccgccgcgggcgctcgccgccctggagccccgcctggatttgctgctgggcgctcgccggctgccaggcggcctgggctggggacctgccctcctcctccagccgcccgcttcctccttgccaggagaaagattatcactttgaatatacggaatgtgatagcagtggctccaggtggagagttgccattccaaattctgcagtggactgctctggcctgcctgacccagtgagaggcaaagaatgcactttctcctgtgcttctggagagtatctagaaatgaagaaccaggtatgcagtaagtgtggtgaaggcacctattccttgggcagtggcatcaaatttgatgaatgggatgaattgccggcaggattttctaacatcgcaacattcatggacactgtggtgggcccttctgacagcaggccagacggctgtaacaactcttcttggatccctcgtggaaactacatagaatctaatcgtgatgactgcacggtgtctttgatctatgctgtgcaccttaagaagtcaggctatgtcttctttgagtaccagtatgtcgacaacaacatcttctttgagttctttattcaaaatgatcagtgccaggagatggacaccaccactgacaagtgggtaaaacttacagacaatggagaatggggctctcattctgtaatgctgaaatcaggcacaaacatactctactggagaactacaggcatccttatgggttctaaggcggtcaagcctgtgctggtaaaaaatatcacaattgaaggggtggcgtacacatcagaatgttttccttgcaagccaggcacattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaatcctactaaatctggagcaggagtgatttcagtccccagcaagtgcccagcaggtacctgtgatgggtgtacgttctatttcctgtgggagagtgctgaagcttgccctctgtgtacggagcatgacttccatgagattgagggagcctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacaataaatttttcatttttccataggttatcttctcttgatttaaatttcaggaagagttagcatgtgcttgggttatctagatttataattgcctttgaaattccatcctcgttggagctggtaagaagggcttgactgaaagtttgaaggaatctaaaaaacaaaaaagtaagaaaggtaacgagaagccctaattctccattaatgcaaactagctgctagtatcatagaagtcaaatgacttaaaacagtttatgtagtgctagaagtataattaaagtaaataggaaagcttgtcaatcaaatcactggcaaaatcatgaagaagagagtgagaaggtttgtctataagtacagatgactgtatgaaatactggggtaatttcatggtctccagaaaatgtcagtgggacttttgttctttgtcaagcaccagaggttatatggttatttttctgctgcaagactttgaggatgttgactttctcagaaactttttaaaaaaataatccaataaggcaggaattcagttttgaaaaattacatataattgtattcataataagaatgtggttatttcataagcagttatgaaagaattattgttcttattcaaaagtgatccagataattgtgatattttctatggtgggctactggtattagcacgacttggatattatttgttgaaggaagtatgaatgaagttggatttgaccaatttcgtgtaaaccttaattgatttaaaactgggaaagaggggggtttcctggccattgctgatctaaggtgctcttatttgtttccaataaacagtaatctttatagaccttaatgcagatttaaaaaaatagttgtgattggctgagagaggcagggcatatatgtagggaaatgatttgccccaagcattccaatgaagtatgacttgtaacttttgtgtctgaaggtggtgtctttatttttgtggaaaatgggagaaaaatgaataattgtgtttatttggctgattggtaatacactagaccattctgttattattgaatgaatgttttgtgtatatctctgctgttgcacatatgagtataggtgaggttgtcattgtttgctctgggattcagggagggagtcactttgcataaacctttttttgcatttaatttcttgaatgttcttataaagaagacattatgttggcattcttcatttttatcctgccaacagagtgcttatgagcatgtctgcattttgatcaaaatttaaacagaagagtgaaaatacatttgaaatgaaccctttcagaggaaccctggcaaagctgtatagactggacagagtgagaaaacttccacagccacctgtcacctttctcctcatcttccactgtgttcaatatgtatgttccaagccatagagataattgggattttctcccaggtagcttctttcttctcctgtcactggactaaaatctctgacatgtcaaaaatgccttaaattttaatgaactctccgaaaatgtagttgatattggagaatttattttatttctaattttagatattaaatatattttgtcagcacagtcccatctttgggaaggaggtgattttttcccttggattccagtggtttgtcattttatttcaagcactgaagaagtatgacagaaagaatattatggggaaaatatttagaccaatcctggctataaaatttcctttagttttatgcctggcctttgcaaagctcagtgaaatgttgaaaggaataaattaatcatgtttctgtgacttttgattgacacttgttccttttcccccctaagtggtagaagaagttatttgttatttttctaaaaggcacaattttgaagccttaactacttcattaagtcaactgttgcctataacatctcttagcactcgtcaaaacgtatttaaatcaattttccaatggatgagaacatgtcttctgtggataaattatattatgtcatttaacaacattgagcattttgatatgtgttcactgaattaaaaaacctgaatttcattattgttgacttttcccctctttagttactagtaatcacatcctttctaggattaaaaatatttcatagtatttttgtgtagatgtctgtccttattttcttcccaaagaaaaaaggttgtttaaattgattatgtggaagaattacttgggtccagtctttagcatctggggtctccaggtccccaggtgggtcatgattgactgcttcttcaagacccatcttgccaactctcacttgatgtctgtcaatagaactacttcctgtggcacatggttatttctaatgggaggctaatgtgtacataatttctctcttcctcatagaaataaatttctctgggggttgctgtgagaggatgacttcattagccatgtttaaagtgagtgtactgctcacgtttatctttgtacactaagagtatgtagagttgatcttcagagaaactaaacctccctcatatctatttatagtaatcatgaatatgattgcagttgacaggcccaactcctaaactgagtttgcccaaagaaaatgtccttagaggagtaaacttttagaaatctcaacacccgactcattcgttggaagctaaaatggaattcatcttcatactaactggctacagattattctcttgctggattttacttttattttaacatttttacatgagttccttttagaatcataaatgaaagaagtaaaactttaagatgggaatgaataattgaaaagagaattatatttactattataattgatattattcgctattatgattacacttgtctagatcagagcccagcaaacattttttttgtaaagggtcagatagtacatagttttggctttgcagggcatgtgggctctattgcatttactcaactctgccattgtagtatgaaagcaaccacatacaaaatgtaaatggatgggcgtggctgcattccaataaaactttatttatggacactgaaa

SEQ ID NO: 145975 - DNA, 4853 bp, Homo sapiens
  Payload ID: 8943
  Gene Symbol: KIAA1328
  Gene Name: KIAA1328
  Uniprot ID: Q86T90
  ENST ID: ENST00000280020
  CDS Start-End: 23-1756
cccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaacaacccaggttattttcaatcagaccaggcattcgataacacactaagggggtaggaatggaagatggtatcttttatatgctaaacagattagaaaattaacataggatactttctgcgtggtggaaaccattgcatattcagcctcatttcaagagtgtttccttctcaaacttctgctagaaaatgctgactcacttttatatacaagaaaaacctttccactgaaaaatccctctgatttaaaagtaacccctttgaaacataagcagtttcagaaaggcagactctctcatctttctcatcctgttctctcactactacatttctgtaagtggtcctttaattctgaagttggagttggtgcccctgccatcacaaacaacacgagagccaattgtgagtcagtctcagtagccatcagcctggcagctgcccatcccataaccaaagagctcaatgggctggagggtgagacccagccaatccttgggagcaagcagcactaaatcacatcagggagtgattagtcctggggaaattcagtggaggcacaagcctgaagcactcttctaccaatgtttgggtgaccacccctccaatatcccagaatgaataagaacaatccctaggtatttttatttacccaagtgttcagcttattcaccccacccccccaccccccatcacacgtgctcctgtgaactttccatggttatgtctacggaaaatgccactagagagagagtgatgcaagctgctgcaaagctgatgggcttcctctggccctcccttttcctccacgaggattaaaggatacaagctgaccaggcctcacaggtgctctgctcgtggccccaaagaaccatctctacttgccagagtatgttccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggctttttttctctcctttttaccaaccccaactaaactgggagtaagacttagtcagtgttggtagacaaagtcataccacccagggcagcctgcatgcagcgagtctgcgtggcttccctgaattactcttttaattaaaactagattatttcaatctagaaaagccttgttgagcagcctccttatccagatagatccaaagctcatgtctcttcaggctgagactggcgctgtcacctccacccagccttctttcacttggggttttttattctttggagtagaaaagaatggagcccactaatattatatttttcttctgaaataaatataaagtcaagactaactagttataatcattcccttaaaaagttggaaaatcattacagattaaaatttctttataaagttcacctctgagagtaaccaaatcggtttcatcccatatcaaaaagcctttggagtgtggagctttctgtggtatggcagaaatgggtggatggcaaactaagagccctcagccattttttcagttaaagttaggttgccagaactttcttttccttgccccctgtgtcatgactagcttaagtgtacttgactcccatagactactcccatgcccacagtcacccattccagactccagtgtccttaaaactctggagtgagaggatgccagaggatcaagaaaaggatcacagtttcttgaagaagcttgtttgcctttagaagaatcgtaaacagagtctaaactaaaggctttttgggggtcacagccacagagtggagttttattgcttctttgcctctccatgaatggccaatttggaaaagcagagatgggctttcagcagaatatcaaccaatacatttttcacatgcaaaactcatcaccagttgcctttttctaacttaatggacattttgttggtgttggtgcaagggcaataggatgtaaatttgtatataatctaatgtcttcattattaattgaatagtacatgttaacattttaatctatttaaatttactttgaaatatatacatacatatgaatgaaaggttgttacagagcctcaaagctgttgcagactatcccaagagaaaggatctggcacaaaggaatctgcctttcctccgtctcaagtctcccacccttgactggttgggatttgctcgtccagcctctagacacttcccaaagcaagactggacacatgccgagggcgttgcggatagtgcctcaccattgcccaccctgctgcccaactcctgtgagagaaaaaccaatcaatgtttacaaaatggaaaaggacacagcatgtcctttgaactccctaagtaaggcccacagttcttgatgcagagaaccaaagtgaatcatagaaaagcttttgctaacagtccgctttccaggaggcaaacttgtgtttatccaaacctgatccccatgatggggacttttctagagcaccccaaatgtcatggggagagagggactctttctgctccctcagagctactcttcacttgtccctgcttccggcaccaagttcataatagagatcttctggccagagaatcaggggagaggagaggcctgatggggcagagctggacgaagtctgctaagagagatggaggctgtggcggactccttccaactcacgatttatcctcagctcagagtgtattttgaatatgagcaaatgtttatgtacgtatgagatttcaagttaataaatcatctctatggct

SEQ ID NO: 145976 - DNA, 1190 bp, Homo sapiens
  Payload ID: 8943
  Gene Symbol: KIAA1328
  Gene Name: KIAA1328
  ENST ID: ENST00000592521
  CDS Start-End: 11-502
ttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagatatccttttgaaagttctcttttttaacgttcaagaagtttgactatttctttttttttttgagacgaaatctcgctcttgtcgcctaggctgcagtgcaatggtgcgatttcagttcaccgcaacctccacctcccggttcaagcgattctcctacctcagcctcccgagtagctgggattacaggcacccaccaccaggcccagctaattttcgtatttttagtagagacggggtttcaccttgttggccaggctggtcttgaactcctgacctcaggtgatctgcctgccttggcctcccaaagtgctaggattacaggtgtgagccaccgtgcctggccagaagtttgactatttcatgaagacaatgtaaactccagagaaataattgttctaatttgtaacagggagtaaatctgcatgtgctgccatttctaggcaatcagaacgtcacttaacaatatgtgctatagcttcctttgtgcctgataaggccatccagctgttctgctgctgctgttaggctgctaagcacatacttgtcaactaaaaaggacaagaagaaatttgggcattgaagtgtagtgttggaactttattaaattctgttgcactgctgtaattgagctggaacctccttgtatttggtattctttctagttaaagctttgacagtcctaggaattctgctctgaaatcataaaaattaaaaaaaaattgtttttactg

SEQ ID NO: 145977 - DNA, 5881 bp, Homo sapiens
  Payload ID: 8943
  Gene Symbol: KIAA1328
  Gene Name: KIAA1328
  Uniprot ID: Q86T90
  ENST ID: ENST00000591619
  CDS Start-End: 787-2508
ttaaatcaataccaattttattctttcatagatggagccagacattcttttatgtttgagggtacaacactgaacaaaataaaacaaaaatcattaccctcttggtgcctacattttagtgagatgagatcaggtcatgaataaggaaaatatatgttcaatgatttttttttttttttttgagtcagagtctcggtctgttgcccaggctggagtgcagtggtgccatctcagctcactgcaagctccgccttctgggttcacaccattctcctgcctcaacctctggagtagctgggactacaggcacccgccaccatgcccggctaattttttttttttacatttttagtagagacagggtttcaccgtgttagccaggatgatctcgattttctgacctcgtgatatgcccacctcggcctcccaaagtgctgggattacagacgtgagccactgcacctggcctatgttcaatgatattggtgctgtggagaaaaaataaagcaggaaagaggcagatagtagcgggaggtaggtaggttgtgggaagagagagttttgcaatttcaagtacctatatggttaggaagtgaaagcttcaatcagaaggtgacatgacatgacatatgacataagtcctaaagtgagccatgaagatatttgaggaaagagcttcctgggtagaagaaatcatacctgcagaagctataagttagttacaaattcccaggtcaaaagaaattatgaattataagaggtatacagaacagaagcagcatttggatgccggataatattattgtattttccttcatgttctcctgcgtagtttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaacaacccaggttattttcaatcagaccaggcattcgataacacactaagggggtaggaatggaagatggtatcttttatatgctaaacagattagaaaattaacataggatactttctgcgtggtggaaaccattgcatattcagcctcatttcaagagtgtttccttctcaaacttctgctagaaaatgctgactcacttttatatacaagaaaaacctttccactgaaaaatccctctgatttaaaagtaacccctttgaaacataagcagtttcagaaaggcagactctctcatctttctcatcctgttctctcactactacatttctgtaagtggtcctttaattctgaagttggagttggtgcccctgccatcacaaacaacacgagagccaattgtgagtcagtctcagtagccatcagcctggcagctgcccatcccataaccaaagagctcaatgggctggagggtgagacccagccaatccttgggagcaagcagcactaaatcacatcagggagtgattagtcctggggaaattcagtggaggcacaagcctgaagcactcttctaccaatgtttgggtgaccacccctccaatatcccagaatgaataagaacaatccctaggtatttttatttacccaagtgttcagcttattcaccccacccccccaccccccatcacacgtgctcctgtgaactttccatggttatgtctacggaaaatgccactagagagagagtgatgcaagctgctgcaaagctgatgggcttcctctggccctcccttttcctccacgaggattaaaggatacaagctgaccaggcctcacaggtgctctgctcgtggccccaaagaaccatctctacttgccagagtatgttccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggctttttttctctcctttttaccaaccccaactaaactgggagtaagacttagtcagtgttggtagacaaagtcataccacccagggcagcctgcatgcagcgagtctgcgtggcttccctgaattactcttttaattaaaactagattatttcaatctagaaaagccttgttgagcagcctccttatccagatagatccaaagctcatgtctcttcaggctgagactggcgctgtcacctccacccagccttctttcacttggggttttttattctttggagtagaaaagaatggagcccactaatattatatttttcttctgaaataaatataaagtcaagactaactagttataatcattcccttaaaaagttggaaaatcattacagattaaaatttctttataaagttcacctctgagagtaaccaaatcggtttcatcccatatcaaaaagcctttggagtgtggagctttctgtggtatggcagaaatgggtggatggcaaactaagagccctcagccattttttcagttaaagttaggttgccagaactttcttttccttgccccctgtgtcatgactagcttaagtgtacttgactcccatagactactcccatgcccacagtcacccattccagactccagtgtccttaaaactctggagtgagaggatgccagaggatcaagaaaaggatcacagtttcttgaagaagcttgtttgcctttagaagaatcgtaaacagagtctaaactaaaggctttttgggggtcacagccacagagtggagttttattgcttctttgcctctccatgaatggccaatttggaaaagcagagatgggctttcagcagaatatcaaccaatacatttttcacatgcaaaactcatcaccagttgcctttttctaacttaatggacattttgttggtgttggtgcaagggcaataggatgtaaatttgtatataatctaatgtcttcattattaattgaatagtacatgttaacattttaatctatttaaatttactttgaaatatatacatacatatgaatgaaaggttgttacagagcctcaaagctgttgcagactatcccaagagaaaggatctggcacaaaggaatctgcctttcctccgtctcaagtctcccacccttgactggttgggatttgctcgtccagcctctagacacttcccaaagcaagactggacacatgccgagggcgttgcggatagtgcctcaccattgcccaccctgctgcccaactcctgtgagagaaaaaccaatcaatgtttacaaaatggaaaaggacacagcatgtcctttgaactccctaagtaaggcccacagttcttgatgcagagaaccaaagtgaatcatagaaaagcttttgctaacagtccgctttccaggaggcaaacttgtgtttatccaaacctgatccccatgatggggacttttctagagcaccccaaatgtcatggggagagagggactctttctgctccctcagagctactcttcacttgtccctgcttccggcaccaagttcataatagagatcttctggccagagaatcaggggagaggagaggcctgatggggcagagctggacgaagtctgctaagagagatggaggctgtggcggactccttccaactcacgatttatcctcagctcagagtgtattttgaatatgagcaaatgtttattcaatcttcaagaagtatcaagtccatccaggcgcggtggcttacacctgtaatcccaggctttgggaggccgaggcagccggatcatgaggtcaggagatcgagaccatcctggctaacacggtgaaaccccatctctgtattttgtatttgtaaaaatacaaaaaattacctgagcgtggtggcacgcacctgtagtcccggctactcaggaggctgaggcaggagaatcacttgaacccgggaggcggaggttgcagtgagccaagatcatgccgctgcactccagcctgggtgacagagcaagactccatctc

SEQ ID NO: 145978 - DNA, 3256 bp, Homo sapiens
  Payload ID: 8943
  Gene Symbol: KIAA1328
  Gene Name: KIAA1328
  ENST ID: ENST00000587139
  CDS Start-End: 1-1805
ggacggcgaggggcgagccgtcgcgtggcagtccgagagcggaggagaagctccgaactaaccccggggatggggacgtgctgctcggccccagtctaggtgctgggctctccccttgcttgggtgttaggtggccgagagactggtactgtctgcaggtgtggggacacggctcagatgcttcccagcgctcactaccgaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattggttaaaagctcaggctctgtttaagtcgagagaactggttgctgaaaaacagcttactaaaccccaagaactcaaactggatatgaatggcagtgactctggaccaagtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaacaacccaggttattttcaatcagaccaggcattcgataacacactaagggggtaggaatggaagatggtatcttttatatgctaaacagattagaaaattaacataggatactttctgcgtggtggaaaccattgcatattcagcctcatttcaagagtgtttccttctcaaacttctgctagaaaatgctgactcacttttatatacaagaaaaacctttccactgaaaaatccctctgatttaaaagtaacccctttgaaacataagcagtttcagaaaggcagactctctcatctttctcatcctgttctctcactactacatttctgtaagtggtcctttaattctgaagttggagttggtgcccctgccatcacaaacaacacgagagccaattgtgagtcagtctcagtagccatcagcctggcagctgcccatcccataaccaaagagctcaatgggctggagggtgagacccagccaatccttgggagcaagcagcactaaatcacatcagggagtgattagtcctggggaaattcagtggaggcacaagcctgaagcactcttctaccaatgtttgggtgaccacccctccaatatcccagaatgaataagaacaatccctaggtatttttatttacccaagtgttcagcttattcaccccacccccccaccccccatcacacgtgctcctgtgaactttccatggttatgtctacggaaaatgccactagagagagagtgatgcaagctgctgcaaagctgatgggcttcctctggccctcccttttcctccacgaggattaaaggatacaagctgaccaggcctcacaggtgctctgctcgtggccccaaagaaccatctctacttgccagagtatgttccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggctttttttctctcctttttaccaaccccaactaaactgggagtaagacttagtcagtgttggtagacaaagtcataccacccagggcagcctgcatgcagcgagtctgcgtggctt

SEQ ID NO: 145979 - DNA, 1835 bp, Homo sapiens
  Payload ID: 8943
  Gene Symbol: KIAA1328
  Gene Name: KIAA1328
  ENST ID: ENST00000590617
  CDS Start-End: 9-254
gtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattggttaaaagctcaggctctgtttaagtcgagagaactggttgctgaaaaacagcttactaaaccccaagaactcaaactggatatgaatggcagtgactctggaccaagtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagt

SEQ ID NO: 145980 - DNA, 1863 bp, Homo sapiens
  Payload ID: 8943
  Gene Symbol: KIAA1328
  Gene Name: KIAA1328
  Uniprot ID: Q86T90
  ENST ID: ENST00000586135
  CDS Start-End: 695-1534
gagatggaagttgcaaaggaagtcatttgggacctttcagaagtgtagtatcctgaaacaccaagcaaattcagaccttcatgctgaggtgaatttgtaaagggtcattgggcgtaccctttgggagaactgatacggccttcagacctttgaccaaaacagataaaataaacacagaaagacataccaagaatgacttaaagggaggaagcaaaggagtccaataatgtattacatttcaacataaaggagaaggatgggcctcctctcactggtgtgaaagagggttcttagagatgattgatacgcataccgtaagtatgttccctggaccagcaacatcagcattactcagaagcttgttagaccctacctcagatctactggatcagaatttgctttccaacaagacccacaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattggttaaaagctcaggctctgtttaagtcgagagaactggttgctgaaaaacagcttactaaaccccaagaactcaaactggatatgaatggcagtgactctggaccaagtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccgcccaggaatctccacaaagatctgcttcctttcaaatcatttcttcatattgttctcctagacaaaatgctaggctacacggattatggaaggaacctattaaggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgc

SEQ ID NO: 145981 - DNA, 1798 bp, Homo sapiens
  Payload ID: 8943
  Gene Symbol: KIAA1328
  Gene Name: KIAA1328
  ENST ID: ENST00000592611
  CDS Start-End: 34-279
aggcgcgacgccccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatgtcaatcttcaagaagtatcaagtccatccaggcgcggtggcttacacctgtaatcccaggctttgggaggccgaggcagccggatcatgaggtttggtgcctggaatgctgacctagatctggaaactagcccagatgaaagcaagaatgatgaggccacagtgtccatgaaagtagggtgaggagggtgtccagtggagccagagggagtgccaagagggaggtccttggaacac

SEQ ID NO: 145982 - DNA, 496 bp, Homo sapiens
  Payload ID: 8943
  Gene Symbol: KIAA1328
  Gene Name: KIAA1328
  ENST ID: ENST00000591911
  CDS Start-End: 461-496
agttctgatttgatgagagtgtaggttgcaatggtgagatggaagttgcaaaggcaatcatttgggacctttcagaagtgtagtatcctgaaacaccaagcaaattcagaccttcatgctgaggtgaatttgtaaagggtcattgggcgtaccctttgggagaactgatacggccttcagacctgtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtcca

SEQ ID NO: 145983 - DNA, 1577 bp, Homo sapiens
  Payload ID: 8943
  Gene Symbol: KIAA1328
  Gene Name: KIAA1328
  Uniprot ID: Q86T90
  ENST ID: ENST00000586501
  CDS Start-End: 301-690
aggtgatcttgtggttctttctaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgctcagagtagtttgatcatctgaatccttctctcaactcgtcaaagtcattctctgtccagctttgttccgttgctggtgaggagctgcgttcctttggaggaggagaggtgctctgctttttagagtttccaagaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggttgggttacccacaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttctcaccaccagacttgccctaaaagagctcctgaaggaagcactaaacatggaaaggaacaactggtaccagctgctgcaaaatcatgccaaaatgtaaagaccatcaaggctaggaagaaactgcatcaactaacgagcaaaataaccagctaacatcataatgacaggaacaaattcacacataacaatattaactttaaatgtaaatggactaaatgctccaattaaaagacacagactggcaaattggataaagagtcaagacccatcagtgtgctgttttcaggaaacccatctcacatgcagagacacacataggctcaaaataaaaggatggaggaagatctaccaagc

SEQ ID NO: 145984 - DNA, 6528 bp, Homo sapiens
  Payload ID: 8944
  Gene Symbol: KIAA1429
  Gene Name: KIAA1429
  Uniprot ID: Q69YN4
  ENST ID: ENST00000297591
  CDS Start-End: 77-5515
ctctcctgagtcgctgtcgcggaggctggagcgctgccccggaagtcctcccccctgttccccgcccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccataccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgtacgtttgtatatattttcccttttttgtatgactatttatttagaaaatttctaggtgaaaaactaaatgatgttttgtatttttcttgcctatagcacagatattctcaaactttctcagctcatgacactatttagtgcctcagtacttttttcacagcatacctggtccaaaagaaatatctaatacttgtgtttattaagcagttagatccaacagcttaataagaatgtacatcatcaccactagtaactgtggacactgcatgtctcaaaccttggaatcagtatcattttcttttcctctctgcttcttgcacagtactttttatcaaactgctgaaaacccagttttgtaaagatatgttgttatagaaaggaatataatgctatttaatgttgaaaatgtaaactacctcaaagtagtagtttatgtgatgtccaacaggtgttgctatgtttttctcaaaaattttaaaatattgtgtggcacccatgttaatttgctaaggtgccctgctacacagtttgggaaccatggctgtaccaaaagaaacaaaatactcctctcctttgtattagaaatctgaactttgcatttcagctttggacctactgacactattttattatacaaattatttaaagcctaaaataaggaatatcctaatactattattttgggaatcagaaacatctaataaagctggactttatacatagaaataaagcttacaactttgagaaagtagccatattttccccaagatacgtcttaacacactgagtctatataagtggcgtaaaatacagagttatcttaatcag

SEQ ID NO: 145985 - DNA, 3924 bp, Homo sapiens
  Payload ID: 8944
  Gene Symbol: KIAA1429
  Gene Name: KIAA1429
  Uniprot ID: Q69YN4
  ENST ID: ENST00000421249
  CDS Start-End: 83-3526
ttctccctctcctgagtcgctgtcgcggaggctggagcgctgccccggaagtcctcccccctgttccccgcccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccataccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggtatcacttccatataacatgcatcttataaatgactgcagtaacactttttaaaaagccagtgattttgttaaaaaacaaaaaccctcatctcccttcctcccaaaaagacataaaataaccggatgagggggagataaaactgaaacaagttggtcattgaggaaatatgggggtaacattttaaataaatttttgttaaagtgagttttattttgctgttatgtatgtttgtacttacatttttctgttattttaaatcctttcccccacaccttaccatgtgttagaatttgccaataactagattgcttcaccaatggactctgctcaactaactgctaacctgagaacaataagattttttagactcattgaattcaagcaaatgtttaactgtataatagaaaattaaatgttttaagcatgcagtaaaaatgttcttttcataa

SEQ ID NO: 145986 - DNA, 609 bp, Homo sapiens
  Payload ID: 8944
  Gene Symbol: KIAA1429
  Gene Name: KIAA1429
  ENST ID: ENST00000523263
  CDS Start-End: 1-274
tcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgct

SEQ ID NO: 145987 - DNA, 3219 bp, Homo sapiens
  Payload ID: 8944
  Gene Symbol: KIAA1429
  Gene Name: KIAA1429
  ENST ID: ENST00000522263
  CDS Start-End: 1-2193
caacctgttaagtctttcccaacgatggcacgaattactggacctccagagagggatgatccataccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 145988 - DNA, 497 bp, Homo sapiens
  Payload ID: 8944
  Gene Symbol: KIAA1429
  Gene Name: KIAA1429
  ENST ID: ENST00000517624
  CDS Start-End: 1-183
gaattagagcgctcatttttgtcagaaccatcatctccaggaagaaccaagactactaaaggattcaaacttgggaagcacaagcatgagacctttataacgtcaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagtt

SEQ ID NO: 145989 - DNA, 668 bp, Homo sapiens
  Payload ID: 8945
  Gene Symbol: KIAA1456
  Gene Name: KIAA1456
  ENST ID: ENST00000532376
  CDS Start-End: 506-668
ctattttttcctcttcctttcatcctcacactctaaaataggtcaaggggtggaagttacacctggtgcagccctcggctctgatgcaaaagcagcttttgcccctggctgcgggacagcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgcagggaggagggggcgcgacaggtcgtctagcgcgtgccccggagcccgcgcccgggtctggccgcctggggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggttgtggga

SEQ ID NO: 145990 - DNA, 9587 bp, Homo sapiens
  Payload ID: 8945
  Gene Symbol: KIAA1456
  Gene Name: KIAA1456
  Uniprot ID: Q9P272
  ENST ID: ENST00000524591
  CDS Start-End: 490-1854
agtattgtgtagtacagaaaagatcacacatgtatatgtcagaagtagatgcacatgttcttttggctttttttctttgttttattcttttttcattttttgtgttttttgttagtttgttttgaattttttttcttgatgcatatgttccttcaacttattcagtacttccatgtgcagggctctggactagactttcaggatctaaggctgaatcctacacagtcctccctctgggaaagtgatgaaacctgtgagctctcctagcaactctgcagtcttccttcaagggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggagtcatacatcatttttctacaaaacaaagaagaatcagagcaataaaagaaatggccagggtcttagttcccggaggccaactgatgatttacgtttgggcaatggaacaaaagaaccgtcactttgagaagcaagacgtgcttgttccatggaacagggctctgtgttcccagctcttctcagagtccagccagtctgggaggaagaggcagtgtggatacccagaaagaggccatccctaccatcctccttgctctgagtgtagctgttctgtttgttttaaagagcagtgtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtttagactttgatcaccaagagccattttcaacaaaagggcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagttgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagagaggttgtgattgattggatccttttagacaactcctccaaaagatgaaccacattctttcctcttggtttgatatggttacctgaatttgcattcagtgttatttgttaatccatttacgctttggtctgcagagactattaattatttggttgttttgttttcatttttgaataagcacagattctggcattgaaagcacttgacaaagggtatttgtgcttaaatgttaatatacaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttgaaccatgtgatgagttatcttgttgccaaggccttgcttctacttaaagttttcagaaaactgagtgacagtggagagaaacaagaagttttacaaggactttactaaattataagcaaacttgcttcaaaataagttgacatgtgataataaggttttcaatgtagcccaggaggtttttaaaggcactgttaggctgagcatggtggctcatgcctgtaatcccagcactttgggaggccaaggcagaaggatcacttgaacccaggagttcaagaatagcctgggcaacatagcaagaccccatctctataaaaattagcaagatgtggtggtgcatgcctgtcatccaagctactcaagagactgaggcaggaggatcacgtgagcccaggaattcaaggctgcagtgaactatgattgcatcactgcactgcagcctgggcaacatagcaagactctgtctcaaaataataataataataataataaaggcgttgttagcttgtaaggagtggagtatgtaggtagtaggagttatatgcaagtacccaagtggtattcttccaatcttattagaagcatgaatattcaagattgatattactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgactacattttattagttatattaggaatttaggtagaatcaacttctactgattacaggttgaatttctgtcactttgtagagaaacgaatagactggacactgtgtggtcactgtttagatttgcccatgggtctctttaaatctatgtcatggatcctgagacacaaatataattaagacaggtctagagacaggagaagcagaaataagttgacccaggagtacagtctcaagtagttcattaatgagaaaattgacatctgacaagagtctttttactttatgctggatgaaaatccaaatcttgttttattttttccactaaaagtgactaaaataataacgaatttcatttgttcttgggttcttttttcctttaatgattgtgctataacttaaaataatgatgttacttttgaacaaacttaaagaaatatttttaaagcgtatctgaaaacgattgatgtttataactctcttttggcttcaaaataagattgtgttatcaccattttggtagatgaggttgtctggtgaaaatgatgcatatgagttgtactgttcagtgtacatcctgcagtagtggatgattgaaaacatatataagtggagtataaattaaaaattaatttggtttcttctatttcttttttttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcaccgtgttagccaggatggtctcgatctcctgacgtcgtgatccacccgcctcggccccccacagtgctgggattacaggcgtgagccaccgcgcccggcctgttccttttatttcttaattcaggacactaaaccatgactgcaagggatttccttggtaaaaagaaaagattctcagagtcaaaatggtcttacaactcgggcttgacggcctttgaattatgaatggattgttcctctctctgaagcctattgtcacatgggtttttaatcctggccttgctgctagaaatctgtgcttgaagtcctctctttctgctgctagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcggcctcaacttgcttgatgatagattctactgacctagctggagtaatctgatcacttacttccttattaatactagatcacacagtgtctttcttattccttcttctttacttactggcatcagcacagagtcccactatctgaaatagaagggagagtttgggggtttattggaggagtcttaaaaacttggttggcagctgggtacgatgactcacacctgtactcccagcacttcaggaagctgaggtgggtggatcagctgaggtcaggagtttgagaccagcctgaccaacatggtgaaaccccgtctttattaaatacaaaaaattagccaggttggtggcgcatgcctgtaatcccagctacttgggaggctgaggcaggagaatcgcttgaacctgggaggcggaggttgcagtgagccgagattgtgccattgcactccaacctgggcaacaagagtgaaactccatctccaacaaaacaaaactttgctggcttcctgatgcctcactgtctatttgaggaattccacagaatcttcaaaggatttgggggaaagcgcattaacatggacaaaggatggaatcaaaataatgttatagtgagaatcattcaagcacctatttaaattttttccaattgccagtatagtgatgatatgacaccagcatatcaaagtaactaacaaactagctacacaaacgtcttggagtttggtttcgttctcttttctcatcatagatctccgtgcagaatagtgctaattcttatttctcgtttgcctttctatttccttccaaattctacatgccagtaattcctctgtcttttaagtgaccatcaattcaataggcaaaaatttggagtaatccagagaaaaaaccatccaaatataaaccagctaggaacatgaatgcccctgattattaatggccaaaaaaaaagcactggtggattttaaattaaattaatacatatatacgagtttggaggagaacagaagttctaactcagtacttgaacttggtgggggagggcacaggttaaatatgagctgtgagcccccagttttggaggaaggaggaaatgggaaccaaccaccagacaagcagctgcagtctaagaaaaacaaattagggcaggcctcagcatctctttcctattacatagaaaatctgaaatgagaatagctgtgaacttttctaaatatgcaacattcaactatcgcaaggacaaaaaaccaaacaccgcatgttctcactcataggtgggaattgaacaatgagaacacatggacacagtaaggggaacatcacacactgggacctgttgtgaccccgctgagggagttcctcttgccctctacccccggggcttgtatatagattataaatatataagggggaaaggggtgggggggaggggttgtgcggctggggcctcacttcccctccttccccttctcctggtcccctgtcccaggggctgtttgttaaaaaagagtaataaaggatttttgtttttaaaaaaagcaacgttcattaatttatatgcagtcctcaccacagccctccaagataactatacttattgttcccattttgcagatgaggaaaactgaggcagaaagaaattaaattgcttaaggttacacacatagtaggtatcacacatttagttagaggcagagctgggattcaaacccaggtctggctcctagtctctgctcttaaccacaacaccatatactcccacccctgggcccagctcatgtgcttggcggagtattagagcctttcaaggtaagtgtgattatcccctttccaaatgagctttggaaaagtttaagcaaagattacacagctagacaataattcaatagtagtctcttacatattttcccttttatctttttttcatttgtaaatctgtttcgatttgatttgaattaaaaaatagttcttggttgcaaaatattctgggaccacttttctccaactcttcaacctttcaacaattatattattgttttcccattttataagtaaggcaactgaggactattcagatatttcattcactccatttgtttactaagccctgctgtgtgctggatacacagtctgctgtgtgctggatacatatgatacaaggtaatgactatctggcatcttgaaggtacccagaatattagaattaactgacccacaggtgccaagctgaaacattcttcgtattccctgtgtgcctattaccaagttatattgtttagtttgaggaaaacaacaaacaaccctcccttagagaatcatgatgcatattagcatatttaaggagtaccctaaagcttggacttaatctagcttaccctagacgtattaacatcctatagcgcacgtgttctgtgggatatatttcagaaaataatatgtcttacagaataaatgcagactcctttggatggcattcaggcccttcataaagtaactctgaattatttttcagtctcatttcctgcagttgcacccgattttttctgttctgcaatctgctattttagacaaagctttcataagaaattacataatgacaagtaattcccacattccctagatatatacttggatttcaaatgccataattgtaatctttctccaaagaaaaatgcacgatacaggcttcattctatcaagaggcatatgaggtaagcgttattatacacccgtccagcagatgggaaaaccacggaagtgggagggaatcaagaagcattaacagaccctccaccaaccgtaatgcttaactcctcttgttccaatcttaactcaaaattatgattattttgattatttaatgattgttttgatagtataaactccatatctgcaacctcagttatctacaacactgaggtgcaaacatttaaaaagatctctcaccaaacaaggattgaaattgtattgcaaatgaaagagctcagcatgagagcacaatcagaaactgaagagagttgatcaaagagaagattctagctgaattgttctatttttaattccccagggatcctacggtctatgacacattaacaggggtgtgaatcatttcagttacatcacatactctgtcctcttgtggtgcgggtcttccccagttgattatacacagataatcaatgactttatttgggagggattggagctatagaataatctatcttaccaatctgatggaccatttgtaagagctgtttgtcaaattggatcttcatttgacaaataaatactagagctgcagaaagtaaagtttactccaacccaattaatcattaatacatccacaggaaaaatacattttctccacatggaatattgatttttctatgaatattacctccacattgaaaaacgagtgagtcactgcagttaagccagtgtaccttgatgttgaattccctgaagaaggtacaattatatttacattcccttagcaagaatttggctaagtgataagcacttttctcttttcttttctttttttttttttttttttgagacagtgtctcactctgtcacccaggctggagggcagtagtgcagtctcagctcattgcaacctctgcctcccaggtttaagcaattctcgtgcctcagcctcctgaatagctgggattacaggaacatgccaccactcctggctaatttttgtatttttttttaagtaaagacaaactttcaccatgttggccaggctggtcttgaactcctgacctcttacgagctaatcataccacttctaactagattttctattaatgtacaaggagggactccactactaaagtttgttttacttctctggttatttacacaaaacgctggcaatacattaaggctcactaatgtggacctaagtgagtatctgagaggctttgaatatgtatgtgcaaactgtcctattttctttatatgctctcttaaatatgtatgtctgtaaatatatatataacacacatatatatatattcctagacatctagtgtttgctgtcattagtgaccaagaaaaagtagttcttttgtgcacgcgtgaatacatcaaattagcaattaccatagaaatgtatttcattgaataaatagcttttgtttgtttgtttgtttgtttcagggaaatttagaacaattattagatgttatagtgcctcttctcgtgttgatacgtgtatttgggtcaaaagtgcaaaaacttttttctacaatgtacagttattttgacttttcccaggggaagctagcaatagttttaaaagcacaaagtgatgtaaaatattttgacttttataataatgcgaagtagttttatttgcattaatcaataatgttcaggatctttttgtagtaagtatattttaaatggtgtaatttgtgtgtttatgatatgtattcaattatttaagttaagtatcagtgtatttttaaaaagtgttcccaggtgaacaaaagtttgcttttcttcaccattctgtacaggacaagcattattcagttcacatagtcagctctcactacacttcaacagaacggggcaagttcgtatttgaattctgttatatttatctaagggaagcaaaattaaccttttaataatagattatctttaatggttattaaaagaatgttattgaccaaaaagacatattttgagattaataaagatgtattagattatccaaaa

SEQ ID NO: 145991 - DNA, 983 bp, Homo sapiens
  Payload ID: 8945
  Gene Symbol: KIAA1456
  Gene Name: KIAA1456
  ENST ID: ENST00000447063
  CDS Start-End: 330-920
agtatttgagggaacatccgggctctggactagactttcaggatctaaggctgaatcctacacagtcctccctctgggaaagtgatgaaacctgtgagctctcctagcaactctgcagtcttccttcaagggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggttgtgggactggaaaatatcttaaagtgaacagccaggtacataccgtgggctgtgactactgtgggccactggtagagattgcccggaatagaggatgtgaagccatgggacttgagcatccatggatttggtatccgagggcgtcctggaaccaaccccccacggatattgagggaccacagtatttttatcctccatgtcaccccatccctgacctccagaaacaaacaatcatttgccattttaaaggacctacactaaatgagcaacagaagagctctcccacccaccaccgactccatgcctgttttcagcattgtagggaggaagagtcccggccctggctgatggctctcagctcctgggatcaggtggcaatggagggtcatgtctcggcttcattgacttcttgcatcgtaaggctcctcttatgagacaacctttcctctcaggcccttaggtccaagtcccctctctcagctttctctgagacctca

SEQ ID NO: 145992 - DNA, 2392 bp, Homo sapiens
  Payload ID: 8945
  Gene Symbol: KIAA1456
  Gene Name: KIAA1456
  ENST ID: ENST00000528753
  CDS Start-End: 924-1106
aggcgccgcaggcctgggttcccggacagctgagcccgagcgccgcctcccgaaaggtgaaggcggcccggggaggcggggacggtgacgggggcgggggccgcgggcggtctcccgacggctgtcgcggggccagcccaaagcccccgatccccggtagctgcgcttcccgcgcggggcgccggagtagggcgggccaagctggcctgcggccgcggcgggaagaagggctagcgaagcacccccgaccgggcccaggcgccggacgccggggggcgcctcgctgcaacttctctttggaagccccgacacgagccccggcccgcgcgcgcgctcccccacggccacgcgcgcaccctgccgcccgcacccccgcgcgccctccgtctattttttcctcttcctttcatcctcacactctaaaataggtcaaggggtggaagttacacctggtgcagccctcggctctgatgcaaaagcagcttttgcccctggctgcgggacagcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgcagggaggagggggcgcgacaggtcgtctagcgcgtgccccggagcccgcgcccgggtctggccgcctggggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggtaaccaggcagcctcatcgctgacataggtaaccaggcagcctcatcgctgacataggtaaccaggcagcctcatcgctgacataggtaaccaggcagcctcattgctgtcataggtaacccagcactgggccgtgtagcatgaaataccttccattgagcctttgcttttcacattgatttttcatttttgttctaataggaatcctgaaattgcacccttggcatgccagtacctagaatattcattttacagcagaaactcgagacagtcaagtcagcagcaagtaaaaaactttctcaaacttttattttatttttattcttttgagatggagtttcactcttgtcaaccagattggagtgcagtggtgcaatctcagcttgctgcaaactccgcctcccaggttcaactgattctcctgcctcagactcccaaatagctatgattacaggcacccgccaccacgcccagctaatttttgtatttttagtagaaacggggttttgccatgttggccagactggtctcaaactcctgacctcagatgatccatctgtctcggcttcccaaagtgctgggattacaggcttgagccaccgtgcctggcctcaaactttacctttagacagtggctcttcagggcctttgtgtacatcctccaccaaaacggacctgacattgattgactaaatcaggatggaaatgatggcttgtgaaactaaccgttgtaaatttaaagatattcacatttgccaaatgtgttctcctctggtggctcactttgagtggctcacatgccttctatagaattgtgggattatggaagaggtccagtaatatcttatgaatctcatgggtcctttcctttaattattctataggtgtttcattataggagcgcatctttaattagacagtattttaataataacttatttgtctggaggacgttggttcagtatcttcgtaaatcaagaactggtaaaccacagcttagtagatctaggactaagacttaaaatgtggttggaatctcactcaaggcctacccacctaaaactgcgttctagcaattgcatgctgactgcacctatgagtcgtaagtctgtagttgcaaagtgtgtctagtttgatattctttctaaatactggtaagagaaacagacataccagaacttgtggcttgctgaagatggtatgagtaatgtggaatctggggaaggggtgcatgtcacatggaaattgggagtctttgaaaaatatctctatcctgtaaattaaaaaataataaatctagtttcggagtgtgca

SEQ ID NO: 145993 - DNA, 1982 bp, Homo sapiens
  Payload ID: 8945
  Gene Symbol: KIAA1456
  Gene Name: KIAA1456
  ENST ID: ENST00000400069
  CDS Start-End: 515-697
aaattaagtgagaagagccgcgctaaagccaagcgtcgtcgtcacccaaggtcaaggggtggaagttacacctggtgcagccctcggctctgatgcaaaagcagcttttgcccctggctgcgggacagcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgcagggaggagggggcgcgacaggtcgtctagcgcgtgccccggagcccgcgcccgggtctggccgcctggggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggtaaccaggcagcctcatcgctgacataggtaaccaggcagcctcatcgctgacataggtaaccaggcagcctcatcgctgacataggtaaccaggcagcctcattgctgtcataggtaacccagcactgggccgtgtagcatgaaataccttccattgagcctttgcttttcacattgatttttcatttttgttctaataggaatcctgaaattgcacccttggcatgccagtacctagaatattcattttacagcagaaactcgagacagtcaagtcagcagcaagtaaaaaactttctcaaacttttattttatttttattcttttgagatggagtttcactcttgtcaaccagattggagtgcagtggtgcaatctcagcttgctgcaaactccgcctcccaggttcaactgattctcctgcctcagactcccaaatagctatgattacaggcacccgccaccacgcccagctaatttttgtatttttagtagaaacggggttttgccatgttggccagactggtctcaaactcctgacctcagatgatccatctgtctcggcttcccaaagtgctgggattacaggcttgagccaccgtgcctggcctcaaactttacctttagacagtggctcttcagggcctttgtgtacatcctccaccaaaacggacctgacattgattgactaaatcaggatggaaatgatggcttgtgaaactaaccgttgtaaatttaaagatattcacatttgccaaatgtgttctcctctggtggctcactttgagtggctcacatgccttctatagaattgtgggattatggaagaggtccagtaatatcttatgaatctcatgggtcctttcctttaattattctataggtgtttcattataggagcgcatctttaattagacagtattttaataataacttatttgtctggaggacgttggttcagtatcttcgtaaatcaagaactggtaaaccacagcttagtagatctaggactaagacttaaaatgtggttggaatctcactcaaggcctacccacctaaaactgcgttctagcaattgcatgctgactgcacctatgagtcgtaagtctgtagttgcaaagtgtgtctagtttgatattctttctaaatactggtaagagaaacagacataccagaacttgtggcttgctgaagatggtatgagtaatgtggaatctggggaaggggtgcatgtcacatggaaattgggagtctttgaaaaatatctctatcctgtaaattaaaaaataataaatctagtttcggagtgtgc

SEQ ID NO: 145994 - DNA, 9265 bp, Homo sapiens
  Payload ID: 8946
  Gene Symbol: KIAA1462
  Gene Name: KIAA1462
  Uniprot ID: Q9P266
  ENST ID: ENST00000375377
  CDS Start-End: 103-4182
gcggcggcggtggcggcgcgaggcggcatgagggagccgctcgtgctgggtcctgccaccaccatggttccagtggttgagctttgctgaagcccaggcatcatgtacagtgtagaagacctcctgatctctcatggatacaagctgtcaagagaccccccagcatcacgcgaggataaccccaaggggcgccaggcagcgaggactgggacacgagcaggccagggcctgcagaacgggcatgaggatggccctgcggccctcgcacatcgtaagacgtccgcggggaaaggacatgtgagtgactccgaaagccgccgcagcacaccgagaggccacggggagccccagagcacttctgcttccagaacctcggaggcggggttttgtaatcaacccccctcagcatggtcctctcatcccccgactggtaacgaccaagcctaccggagaagaggacggcaagaagccaggagccagaagccgagggagcacgaaaacctggaggccagaggaatggcccaagcccacagcctgcctgtccacgtgagggagggtccatgggaagttggaggaaggtcagagcatgtgatgaagaagccagtttgggaagaagaattgcgaatgtcaggtcctgccaagtggcagaacgtcagcctggaaagctggaaccagccaaggaaattagggaggcagatgtctgatggagatggggagagactgtttcaagacctgtacccattcattcaaggagaacatgtgttgaattctcaaaacaaagggaagtctcgctcactgcctagagttctttcccccgagagcctgagttgcacggaaattcccattccattaaatgaaagacattcacctaaaatgccaccgtatcctcccacttgcgcaccaaatttggactccacgaggaattctgagaagagtggctgctcagccccatttccccggcctaagtttgggaggcccctcaagcccccatcttacagctcgcaccagcagtctaggggaggagcggacagcagtgactctcaggacagccagcagatggacgcctatgtccccaggcatgagctctgcctgtcagaccctggattggaacctccagtgtacgtgcctccgccctcatacagatcgcccccgcagaacatcccaaacccctacttggaagacacggtgcccataaatgtgtgtggcggtcacagtcaacagcagtctccgaccgagaaggctggggccagcggtcagcctccttcaggcccccctggaactgggaatgagtatggtgtgagcccccgcttgcctcaggggctccccgcacatccccgacctgtcactgcctatgacggcttcgttcagtacattccctttgatgatccacggttacgacattttaaactagctcagccccagggtttctgtgaagacataaagcttgacgataaatcatataactccagtcctgtcactgctcaagagccggctcatggaggaatgcagcctgatggtgccatttggaatccacagagcttaatacccccgtcgggggatgagagaggcctggtcttggccgattccagcccccggtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaatgaacgagactatattttgcttggtttctatcccagtgaaatcagaatcacatctgccagatagagatatggacaacaatgacttaaagcccagtgctgatcaaaagaatgggtctgataagagcccggctctgcaagaacagagtctgctgagcatgtcttccaccgacctggagctgcaggccctcacaggaagcatgggtgggagaacggagttccaaaaacaagatctaggggaaccagaagaagacagacaaacaaatgacctcagtttcatccaccttacaaagcacagagaactcaagcattctggctcttggccagggcaccggtacagagatcagcaaacacaaaccagtttctccgaggagccccaaagttcgcagctgctccctggtgcaaagctgggagggccgagtcgtgcagcattgagtccaaaatgttcagaccctgctgcctccgaagctcagacgcacacagcattccctaccggtgatcacaaacagaggccaagtgcccgtaacctgaaaggtcacaggtccctcagcccatccagcaacagtgcgttctcaaggacttccttgtccgtggaccaggcaccgacgccaaaagcaggccgaagtcagccctgcgtggatgtccacgggcttggagcccaccctgggcctaagcgggaggtggtgaagggggagcccacgggcccttgcaacagtaaacaactctttgggcagtttctcctgaaaccggtcagccgtcgtccctgggatttgatcagtcagttagaaagttttaacaaggagctccaggaagaggaagaaagcagcagtagcagcagcagcagcagcagcagcagtgaggagagtgaggcggagccgcagcaggagaaccgtgctcactgcagacaggaggatgtgggcttccgcggaaacagcccggaaatgagggttgagccacagccgaggatgtgggtgccggagagccctgtgtgtaggtcgggaagaggtgagagtaagtctgagagctggagtgaggagctgcagcctggccacccacgtgcctggcctccatccccgggccgctttcgcgtggaagaaggtggcggtgcacctttctgctcagcagatggaagcacgagtgcagagaagagacacctggaggttagcaacggaatggacgagctggcaggtagcccatttcctgtgacgagaatgtcttcaagatcaagtgacgcaaaaccactgcccgcgtcctatccagctgaacctagggagccccaggaaagtccgaaaatcaccagtgctttcagctctgtgaaaccaagtgaagcggtccctcggaagtttgacagtggtggagagaggggggcagggctcccactgtccctgtctaacaagaaccgagggctctcagctccagacttacggtctgtggggctcacccctgggcaagaacagggtgccagtgagctagaggggtctttgggtgaagcaagcacaatagaaatccccccaggtgagtccttgcaagccagggctgcaaggatcctgggcattgaggtggcggtggagtccctcctgccgggcatccggagagcgggacagaaccagcctgctgagcccgatgcaagtgcctgcaccccagagtccccccaggaagagttgctatctcgcccagcaccggcagatgtccccagggtgtccactgatgccttttatggcaggaggaagtgcggctggaccaagagccctctctttgtaggggacagggacagtgccaggcgggctcctcaggcttttgagcactcagatgtggacggggttgtcaccagcacagaccctgtccctgagcctgagcccagccccttggagtccaagttcttcgaacaaaaggatgtggaaacaaaaccacccttcaggtccactttattccattttgtagaaagaaccccaagtgtggcaggctctgaaaagagacttagaagcccttccaaagtgattgaaagtttacaagagaaactggcctccccgcctaggagagcagaccctgaccgcctgatgagaatgaaagaggtgagctcagtgtcacggatgagagtcctgagcttcaggaatgccgactcccaggaggacgccgaggaattgaaggccaccacaaggggccaggccgggctcccgggaggccttgtgtctcctggcagtggggaccgtgcccagagattgggccactcactctctgtgtccaaggacagcatctccagggaagagaaggagcatccggcagcacaaaaggagaagagcatggatcaagacttctggtgcccagattcctatgaccctagcagagtggagagggtgtgatgaaatgccggtggagcttgcattccgttgcgaattgagtattctcaagtagctggtagatttagtctatcagccccacttccccatgtagaagctggaagctgctgagtttttagcatcctgataacattctttaccactgccactaggaaacttgccatcctctcagaattgctttgtggcgataaagcaatcgtccgttgaaaccatctgtttttatagcatgaagatttaatgcctataattaggaaggagttttcacagaaaccctccctcatgacagatttgactaagctggtaaatagtttggtgttgctctcattctgggtgaagatttcaatgtggaagatctagcaaatgctttggaaaggcctgtgaatggtgtgctcccctctgtgtctccatggcctgcagtccatgctcttgtgaaggagtttgggacactggctgttgcccggtgtttcagcactttcagtttaggggaaatgtgaatcaataggtatgatccatttctaatcaatttggccttctgctgctggaagtaactttacttataagtaacttgccatcagagaataaaagcaatatcttttaagttcctgaaaaattaaaacttgtactgtaatatactaagagtattatttatctggcagtgaaatattttgatcatttgcaaacacgccattgtctgctttgcactcagtattatctatttttattttctgtatgggtatttagaaattctttatatgaaaaataattgctggtttaaaatagaccattttaacaaagtgactatatttctttttacgaaaatgctatttttctatgatgtaaacaattgttaggcggcagatttttaaggaagtattattttatttaagagtctgtatccctttgtgtgagaggaacccaaagagggttcacttttgctttaaagctctgtcccttacccactgacaactctgctacttttattttatcttagaaaatgtcaatatagacatatcacagggttaataaaagaaacttttcacaaagatttttgtacaagtgtagctatcaggttatatttgaaaataaccctctgaaaaccagccaacattgtcatgacaatttttgctgccgtatcaactagaattaccaaaaaacatagttttatctttgtatgtgtgtggggatctaccctgagaccatgcttttcttcccaccctgccaccccacccctttaaagaaatacgtatttttatctagaatgatcttgaattagtctctgcatatttttagaaagtgcttggggacattatatatatgccattacaaaagcattatgaggcctatgtattctactgtgtttaatactgcattaacctgcacaaagtttatgcattttttcatgcatttttttccttctttctaagtaaggtattcctgacaactaacattccctaaatcatttcccctccctccctccctccctcccttcctttcttccttccttctgtcctccctcccttgctacctcttgccctccttccttcaccctgtcctccttttcccttttattttttccccttctctttcattttattttcttttagagaaaccaccttatctatttttagacatttcgaattcctaaaatgtgaaccgttgggtgatctgtcctttggccctaaaacggctggccgggctgtcccggcctgttctcatctgtaccgtatgattttatttcataataactttatgtatttggactgtaacaaacaaaacagaacctaagtcgccccgaaaaatctttccaagccttttcaaaacacttatctgcagtccagaattcagctcttatgaaaagtgagagtgcactccagttttcacagcagcaataagtgcgggaaacaaaaagatcctcttcccaggaaaagttgagtggggaagagttcagacactgttgtagctggtgaatcattgaagtcacctggtagtaccaaataagggctgaggcgcctggaggtctttgtggggtcttccctctttaaatgcaaacgtaagaaggtatatgtgtatatacatttatatacgtgcacatgtatactcgtacatgtatgcacacatacccatacatgtatatgaactccgttctgatttcctctgaaattttgttgataccatctaaatacctctttgaatcaaaataacttaattttagctcattcctcaagagaaagagaaggatccccaaggaagaaaaactgttgtaccttctgtgattctcaaaccaaaatgtgatgcgcttctgttttgttatcttaaattgttgtatcatatctttctgaaaccattctgaattaagttgaaattttcaacatttatactttaactgttctaaatttaagcctacatgtaaatcttttttggggggaaggtaacttgaaaagtttaacttgaaaatttgacctttaaactttcatattctaaggtaaataatagcctataaccaacaacagctttcccagaggtcttgaatttaacactaattgtttagttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttattctgacagcatctcggtttggggcttctgaagaaaaaggatgaagctgatctgttgaaacaactactttcccaactcggaggcaaaaggggctgatagaagataacattcacctaccatttcatcttgtgacccccagagatcacgtttgcgtgttctggctgagttttttattattgtttgttttaaatgattaaataatacacaattaaatgtcaggatagcatctcttgcaaagtgaccagtgcagcagaattgtctttctatccatatttgagcttagagaaacatttcccatgtcctaagttcttagaagcaattactttagcgttggggagcattgttctaccagacccatttatgcaggggagatgaagcttaaaagacgggatgtggggtgggagtgtgtttcttaagccgaagctgttgcaggctgggggatttttgcattttctttttgttttgtttttgactgcagattctgtacatctgtctgtgggaggagagttgctactcaggacaggatttaagagacacattccagtgacctttaagaatctgcatggcgggaggtccttctccaggagtgtgggttggtccactctgggacccaccacactaagaagggggagatgataaaataacattaaaggaagaatggcctccagcctgcaggttttgttggaaagaaataaaaagggagtcattaagaccataaattcagattgaggcctcttgaaaaggttgatgtgggctagcaacctgcctgtcgaaacagtccttggttcatcagcagtgtgggaaggcagccaaggctcctgcagattcctggcatcgaccttggaaagcctctgcgatacttgtgtgtacgaatacagcagaggacagggaggtccttgttctgtggtctctgtttagtgactgaaacttaaacccaaaggcaagcccagattgtctggccgttcatccccatgctttgataggggttaggaggaaccctttccgtatgaaagacaggccctactagggcttacaaccaagccaaaggaccatctcttctttcttccacctcccttcacccctgccccgcagcagagccgagatgtgagacattcattgtcacggagcaaggagacaaaggcaagttcaagttgagaagcatatggcagcaaacagaaatgaaaaccatatgtcccagcaaggggaaaagcagtcatttccagattataaaaatcaatgaagtactctccacctaggtcagctgaaattcgagccctcacagtcaggcctgtcagagaagttaagcagaaacatctcggggggacttctaaaatttagtgaagacaaggccttgcaactccaaagaaactttttttcccccccttgaaacagggtcttgctctgttgcccagcctggagtgcagtggtgcagtcacggctcactgcagcctcaagctcctgggctcaagcactatccccacctcaacctccttagtagctgggactacaggtgcacaccaccatgcccagctaaccacagaaactttcatctcttcattttttctttgggcaccattaatacctaagacaggtagaaagggtcccagaaagacaccattggtaatggccgattgccggctgcagtcatcgcccccagatcaggctggtacaggatgccttaaggtgatgagaggtgagggtgcatgaagaataatgagcacagggaagagagaagcaggacaaagtagcagataaaatgccggcaaagcacagatgaatgtcttcaagaagctcttgtatttctctgcacagtgtaaatatccttgctatttcaggatggcggctggcctgctcagtaacatacatgttccaaataaagattttgcatgaaagta

SEQ ID NO: 145995 - DNA, 5579 bp, Homo sapiens
  Payload ID: 8947
  Gene Symbol: KIAA1468
  Gene Name: KIAA1468
  Uniprot ID: Q9P260
  ENST ID: ENST00000256858
  CDS Start-End: 249-4001
tctcgcgagactggagaccaggaagacgcctgcagagccgggctgctggtgcagcagaggctgaggcatcaggtgcagctgcatccggatctcctgccttggagcgtactccttgtctctaagtcgggaggcaggacgtggtcaggccggggctgtggaggtgcgctgtgtcccctgaggcctagaggattcgggctgcggcccgtcggaaccagtcagggaggcgcccacactcctgacaggataagatggcggcgatggcgcctggaggtagtggcagtggtggcggcgtgaatccatttctcagtgattcggatgaggacgatgacgaggtagctgcaacagaggaacggcgggcagtacttcggctgggcgccggaagtggcctagatcctggctctgcgggctcgctgtcgccacaggatcccgtggccttaggaagcagtgcgcggccagggctccctggggaggcgtcggcggctgcagtggccctggggggcaccggggagaccccggcccgattatcaattgatgcgatcgctgctcagctgttgcgcgatcaatacttgctgaccgccctggagctgcataccgagctgttagagagtggccgggagctgcctcggctgcgcgactacttctccaatccaggcaacttcgagaggcaaagtggaaccccgccggggatgggggcgccaggggtccctggagcagccggcgttgggggcgctggaggtcgggaaccgagtacagcgtcgggcgggggacagctcaatcgagctgggagcattagtacccttgattctttagactttgcaagatattcagatgatggtaacagggaaacagatgaaaaagtggcagtcctggagtttgaactacggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcagataaaggagtatttgcatatacataatgagatatcttgggaatgggacccaagtctaaacacaaaatgtgtttcatatacacattatacacatagcctgaaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgttggtgaagggggtgaatgaaactctggtagctcagagggttgttcctgctctcattactctctccagtgaccctgaaatctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacactttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcat

SEQ ID NO: 145996 - DNA, 6178 bp, Homo sapiens
  Payload ID: 8947
  Gene Symbol: KIAA1468
  Gene Name: KIAA1468
  Uniprot ID: Q9P260
  ENST ID: ENST00000398130
  CDS Start-End: 233-3883
accaggaagacgcctgcagagccgggctgctggtgcagcagaggctgaggcatcaggtgcagctgcatccggatctcctgccttggagcgtactccttgtctctaagtcgggaggcaggacgtggtcaggccggggctgtggaggtgcgctgtgtcccctgaggcctagaggattcgggctgcggcccgtcggaaccagtcagggaggcgcccacactcctgacaggataagatggcggcgatggcgcctggaggtagtggcagtggtggcggcgtgaatccatttctcagtgattcggatgaggacgatgacgaggtagctgcaacagaggaacggcgggcagtacttcggctgggcgccggaagtggcctagatcctggctctgcgggctcgctgtcgccacaggatcccgtggccttaggaagcagtgcgcggccagggctccctggggaggcgtcggcggctgcagtggccctggggggcaccggggagaccccggcccgattatcaattgatgcgatcgctgctcagctgttgcgcgatcaatacttgctgaccgccctggagctgcataccgagctgttagagagtggccgggagctgcctcggctgcgcgactacttctccaatccaggcaacttcgagaggcaaagtggaaccccgccggggatgggggcgccaggggtccctggagcagccggcgttgggggcgctggaggtcgggaaccgagtacagcgtcgggcgggggacagctcaatcgagctgggagcattagtacccttgattctttagactttgcaagatattcagatgatggtaacagggaaacagatgaaaaagtggcagtcctggagtttgaactacggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgagctgactcttcgaggcatgagtgaagcgttagttgacaagcgggttgctccggcccttgttaccttgtccagtgatcctgaattctctgtcaggattgccacaattccagcctttggcactattatggaaacagtaattcaaagagagttgctggaaagagtgaaaatgcagttggcttctttcctggaagatcctcagtatcaagaccaacattctttgcatacagagatcataaaaacatttggtagagttggccctaacgcagaacccaggttccgagatgagtttgttataccacatttgcataagttagccttggtgaacaacttacagattgtggattctaaaagactggacattgctacgcatctttttgaagcctacagtgcactttcctgttgtttcatttcagaggatttaatggttaatcactttttacctggtctcagatgtttacggactgacatggaacatctctctccagagcatgaggttattttaagttccatgataaaagaatgtgaacaaaaagttgaaaacaagaccgtccaagagcctcaaggctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccaccagcattactctgtgccttttggacatcagtttgtgtgttctgtaggaattgtgtgcattccattcacacagtatttctttaggatgctgtgatgatttgaattacaaatcctacagtcaatagctaaagacgaaaccttcatttcagaactctcatgaatattctttaagtgctatttaaacctccccagcacttagatgcatataatggacttacctgaggaaagacagcacataggcatggggagaggtaaccaaggtgaattttacaaactggtgtatagtagatttaaatgctcaaaaataaatgtaactgagaagagttaataattgtgagatttttcccaaattgagatacagaagaaaatatagtttgaatctgaaatttaacacttatttatgtaaaacactttatttaagatattttctaatgattttaattttagagagtaccttttcattctgtgtgttacagagaagtactgaaaagttaaggacacttgggggctacttttttccctctaaactaaaaaagacattggctgaattataactagttagttatcacctcgtcccttaaagtcagtgacctcctgtgtttgatgtatattacatagagtcttaagtcagtgtacagttccactggaatttgacagttgtctctacagtcatgcaactcgaagtagaaaagagtgctggacataggaagggggtgcttggtttgaggggttaatgtgaggcctttttgaaaaatgaatattttgataaaaagaattcttgttttagcacagttgatgcacataagtgattctcatatttgttgtataaactggtttaatacatttggaacatagttggattacattcatttcctgggaaagctagcttaccatacattcaagtttataaaacaatttgccataggcaaagccatttaaaaagttcattctgaaattatttcatttacctacagtgaaataattgtgaactaagtagtctttctgaaaactgttgggttctaggcattcctgagaaattgaaagtggctacctttcatgtcaaaaatgttgatctattataaataaaatgtttttgcatatgtttttgatttggtttgggctatgcattttactttcgttttgaaacactatactttctattaagcaaaaaaatgagaaaagcctatattcatgagaatatactaatattttgtaaatataatttatataaatttacctattttggtttatttttactaaaaggggaccatgttgctataaaactaatacatttcagaggtacctggaagaaaaatgtttaaactctgatttgcttcaaactatagtagaatatgtgtatgtttgttatcaggtgaatgggtagaatgtatttttattgtgaacatttttcttaattaatgaatatatttatttaagtgctaatgtttttttaaaggcaatagtaggcaagattcacagtgtatttcaagtgagagtctcttttcttaaatattttaatatcattaagatttcacattgtggttttgttttttgtttgtttgtttgtttttagtaaaatatgtcttgtctttacagacaagacagacactaatcattgagactgagatttggactgagtccaaaatagggcataaaactcccatactcattccttttaaacagaagtaaacttacggtacaagtttttaagtgttcaacttaatgaaaaactaagtttgcaaagtaatgaaaagctaatttgaaattatacctgtgtttccagagtaatccagagattaaattttttcagaaatcc

SEQ ID NO: 145997 - DNA, 764 bp, Homo sapiens
  Payload ID: 8947
  Gene Symbol: KIAA1468
  Gene Name: KIAA1468
  ENST ID: ENST00000588446
  CDS Start-End: 1-764
ctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattgattcctcagcaggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgaggtatgtcaacacatgcctctgttggtttcaattataatgatttttttttttttgcgaagaagaagggaattttttttaataaaaaggctttgcatatca

SEQ ID NO: 145998 - DNA, 3268 bp, Homo sapiens
  Payload ID: 8947
  Gene Symbol: KIAA1468
  Gene Name: KIAA1468
  ENST ID: ENST00000587725
  CDS Start-End: 216-3268
agagccgggctgctggtgcagcagaggctgaggcatcaggtgcagctgcatccggatctcctgccttggagcgtactccttgtctctaagtcgggaggcaggacgtggtcaggccggggctgtggaggtgcgctgtgtcccctgaggcctagaggattcgggctgcggcccgtcggaaccagtcagggaggcgcccacactcctgacaggataagatggcggcgatggcgcctggaggtagtggcagtggtggcggcgtgaatccatttctcagtgattcggatgaggacgatgacgaggtagctgcaacagaggaacggcgggcagtacttcggctgggcgccggaagtggcctagatcctggctctgcgggctcgctgtcgccacaggatcccgtggccttaggaagcagtgcgcggccagggctccctggggaggcgtcggcggctgcagtggccctggggggcaccggggagaccccggcccgattatcaattgatgcgatcgctgctcagctgttgcgcgatcaatacttgctgaccgccctggagctgcataccgagctgttagagagtggccgggagctgcctcggctgcgcgactacttctccaatccaggcaacttcgagaggcaaagtggaaccccgccggggatgggggcgccaggggtccctggagcagccggcgttgggggcgctggaggtcgggaaccgagtacagcgtcgggcgggggacagctcaatcgagctgggagcattagtacccttgattctttagactttgcaagatattcagatgatggtaacagggaaacagatgaaaaagtggcagtcctggagtttgaactacggaaagccaaggagaccattcaggccctccgagccaacctgacaaaggccgcagaacatgaagttcctttacaggaacgaaaaaattacaaatcaagtcctgaaattcaggagccaatcaaacctcttgaaaagagagctctaaacttcttagtcaatgaatttttattgaagaataactataagcttacatcaataaccttttcagatgaaaacgatgatcaggattttgaattatgggatgatgtaggattaaacattccaaaacctccagacttattgcaactctaccgggattttggaaatcatcaagtaactggaaaagatcttgtagatgtggccagtggagtagaagaagatgaattagaggcccttacaccaattataagcaaccttcctccaactcttgaaactccccagcctgcagagaactccatgttagtacagaaattagaagataaaattagtttgttaaatagtgagaaatggtcattgatggagcaaatcagaagacttaaaagtgaaatggacttcctcaaaaatgaacactttgccatcccagcagtttgtgactctgttcagcctcctttggatcagttgccccacaaagactctgaggacagtggacagcatccagatgtaaatagttcagacaagggaaaaaacacagacatccatctttcaatatcagatgaagctgattccactattcctaaagagaattccccaaattcattccccaggagagaaagagaaggaatgccaccttcttctctatcaagtaaaaagacagttcattttgataaacctaataggaaattgtctcctgcattccatcaagcactactctctttttgtcgaatgtcagcagatagtcgtttaggatacgaggtgtctcgtattgcagacagtgaaaaaagcgttatgttaatgctgggacgctgcctgccacacattgttcccaatgtgctattggcaaagagagaggagttgatccccctcatattgtgtacagcatgtctacatcctgagcctaaagagcgagatcagcttctccacatacttttcaatttgatcaagaggccagatgatgagcaaaggcaaatgatactgacaggttgtgtggcatttgcgcgtcatgttggaccaacacgtgtagaagctgaacttttaccacagtgttgggaacagattaatcacaaatacccagaaagacgactgcttgtggcagaatcctgtggagcactggcaccttaccttcctaaagaaatccgtagctccttggttctttcaatgttgcaacaaatgttaatggaagataaggcagatttggtaagagaagctgttatcaaaagccttggtatcattatgggatacattgatgatccagacaaatatcatcagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggaaggagaacatggactggatgaacacaaactccacatgtatctttctgccttgcagtccttgatcccatctctctttgcattagtgctacagaatgcacctttctccagcaaagccaagcttcatggtgaagtgccacagatagaagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgttgccacaacttatagaaatagttggcaaaattaatgttacttcaactgcctgtgtccatgaattctccagatttttctggcgcctttgccggacatttggcaaaatttttacaaacactaaggtaaaacctcagttccaggagattttaagactatctgaagaaaacattggaaatggggtcctcactaaagctacagtccccatttatgcaacaggagtccttacgtgttatattcaggaagaagaccgaaaactgttagttggattcttagaagatgtaatgacgctgctttcattatctcatgctcctcttgatagcctgaaggcttcttttgtggaattgggtgcaaacccagcctaccatgagttactattaactgttttgtggtatggtgttgtccatacttcagcactcgtgaggtgtactgctgctagaatgtttgaggtatgtcaacacatgcctctgttggtttcaattataatgatttttttttttttgcgaagaagaagggaattttttttaataaaaaggctttgcatatc

SEQ ID NO: 145999 - DNA, 878 bp, Homo sapiens
  Payload ID: 8948
  Gene Symbol: KIAA1522
  Gene Name: KIAA1522
  Uniprot ID: Q9P206
  ENST ID: ENST00000294521
  CDS Start-End: 137-568
gtctggagccggtgctctgcggcggggcgggagggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggct

SEQ ID NO: 146000 - DNA, 5294 bp, Homo sapiens
  Payload ID: 8948
  Gene Symbol: KIAA1522
  Gene Name: KIAA1522
  Uniprot ID: Q9P206
  ENST ID: ENST00000373480
  CDS Start-End: 104-3211
ggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 146001 - DNA, 5293 bp, Homo sapiens
  Payload ID: 8948
  Gene Symbol: KIAA1522
  Gene Name: KIAA1522
  Uniprot ID: Q9P206
  ENST ID: ENST00000373481
  CDS Start-End: 70-3210
gggctgcgggcccggcggccgggctggctgggccgcgcttgggttcccgcgccggctcccgcacccgcaatggggaactcacaccacaagaggaaggcccccagcggtccccgggtccgcagcttctggcggttcgggcggtcggcgaagcggccggcaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 146002 - DNA, 5438 bp, Homo sapiens
  Payload ID: 8948
  Gene Symbol: KIAA1522
  Gene Name: KIAA1522
  Uniprot ID: Q9P206
  ENST ID: ENST00000401073
  CDS Start-End: 71-3355
gcggccgcccccggcatgggcaccgcgccgcagggggcctgacccgccgcccgctccgcccccgcctgccatggcggcccgcgcgccccccgccgcacctgcggccgaggagccggggaacccgggcggccccccgcgcaggaagaagtcccgctccggcgcgtccggcctccgccgcgccttcagctggctgcggggcaagcggcgcaagaagaaggcggcgggggccgagggcgccgaaccggccgccccccgggccaagaaggcggaggacaaggccaagagggccaagggcaaaggccgaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 146003 - DNA, 4075 bp, Homo sapiens
  Payload ID: 8949
  Gene Symbol: KIAA1524
  Gene Name: KIAA1524
  Uniprot ID: Q8TCG1
  ENST ID: ENST00000295746
  CDS Start-End: 78-2795
aaaaaaagcgcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaattactatttgttctatagaggagatacattctgtttctcttttgaaattgcatgcattttcaaccaaatatgaaaaagtttaagtggatagataagactgaagaataaaagggtctataaaa

SEQ ID NO: 146004 - DNA, 2764 bp, Homo sapiens
  Payload ID: 8949
  Gene Symbol: KIAA1524
  Gene Name: KIAA1524
  ENST ID: ENST00000481530
  CDS Start-End: 78-443
aaaaaaagcgcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatg

SEQ ID NO: 146005 - DNA, 654 bp, Homo sapiens
  Payload ID: 8949
  Gene Symbol: KIAA1524
  Gene Name: KIAA1524
  ENST ID: ENST00000468953
  CDS Start-End: 82-228
aatcaaaaaaagcgcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggagctcacctattgtctttgggaagaagcagaaggaataatcccataactaccctctgggcttcatttttcattctcctccctcaaagtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtcta

SEQ ID NO: 146006 - DNA, 3877 bp, Homo sapiens
  Payload ID: 8949
  Gene Symbol: KIAA1524
  Gene Name: KIAA1524
  Uniprot ID: Q8TCG1
  ENST ID: ENST00000491772
  CDS Start-End: 474-2714
ccttaacttctgagctcacctattgtctttgggaagaagcagaaggaataatcccataactaccctctgggcttcatttttcattctcctccctcaaagtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctataccaatacagtcattaattttacttggtgttttcttcaccatatgtctgtttgatttaagtgaatttagatttgtacagttctggaaattttttaaaaaatattatgcagagtaaaacattttaaattact

SEQ ID NO: 146007 - DNA, 2839 bp, Homo sapiens
  Payload ID: 8949
  Gene Symbol: KIAA1524
  Gene Name: KIAA1524
  ENST ID: ENST00000619684
  CDS Start-End: 37-2757
cggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactagcagtagacattgaaaccagagattgtcttcagaatacatataatctgaatagtgtgctggcgggagtggtttgtcggagcagccacactgattcggtgtttttgcagtgcattcaacttctacagaagttaacatataatgtcaaaattttctattctggtgccaatatagatgaattaattacgttcctgatagatcacattcaatcttctgaagatgagttaaaaatgccttgtctaggattattggcaaatctttgtcggcacaatctttctgttcaaacgcacataaagacattgagtaatgtgaaatctttttatcgaactcttatcaccttgttggcccatagtagtttaactgtggttgtgtttgcactttcaatattatccagtttgacattaaatgaagaggtgggggaaaagctattccatgctcgaaacattcatcagacttttcaactaatatttaatattctcataaacggtgatggcactctaactagaaagtattcagttgacctactgatggatctccttaagaatcctaaaattgctgattatctcaccagatatgagcacttttcttcatgtcttcaccaagtattaggtcttcttaatggaaaggatcctgattcctcttcaaaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaactcctctctgtggagatgatacactaaaaatgcatattgcaaaaatcttgacaactgtcaagtgtaccactcttatagaacaacaatttacatatggcaagattgacctgggatttggaacaaaggttgcagattctgaattatgcaaacttgctgctgatgtaattttgaaaactcttgatttgattaacaaacttaaaccattggttcctggtatggaagtaagcttctacaaaatacttcaggacccacgtttgattactcctttggcttttgctttaacgtcagataatagagaacaagtacagtctggactgagaatattattggaggctgctccactgccagattttcctgctttagtacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtaaaggatcagatttgtgatgtgagaatatctgacataatggatgtatatgaaatgaaactatccacattagcttccaaagaaagcaggctacaagatcttttggaaacaaaagctctagcccttgcacaggctgatagactgattgctcagcatcgctgtcaaagaactcaagctgaaacagaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagagaaatgaaagtactgaaaagaagaataaagatttacagatcacatgtgattctctgaataaacaaattgagacagtgaaaaagttgaatgagtcactcaaggaacaaaatgaaaaaagtattgcccaattaatagagaaagaagaacagagaaaagaagtacagaatcagctagtagacagagaacataagctagcaaatttgcatcaaaaaacaaaagtacaagaagaaaagattaaaaccttacaaaaggaaagggaagataaggaagaaaccattgatatccttagaaaagaattaagcagaacagaacagataagaaaagagttgagcattaaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagtta

SEQ ID NO: 146008 - DNA, 147 bp, Homo sapiens
  Payload ID: 8949
  Gene Symbol: KIAA1524
  Gene Name: KIAA1524
  ENST ID: ENST00000625495
  CDS Start-End: 1-147
atggactccactgcctgcttgaagtccttgctcctgactgtcagtcagtacaaagccgtgaagtcagaggcgaacgccactcagcttttgcggcacttggagctcacctattgtctttgggaagaagcagaaggaataatcccataa

SEQ ID NO: 146009 - DNA, 12379 bp, Homo sapiens
  Payload ID: 8950
  Gene Symbol: KIAA1549
  Gene Name: KIAA1549
  Uniprot ID: Q9HCM3
  ENST ID: ENST00000440172
  CDS Start-End: 50-5854
gacccgagagccgctgagccgcgaggccgggccggggcgccggccgggaatgccgggggcgcggcgccgacgccgaggcgcggccatggaggggaagccccgcgccggggtcgcgctggccccggggccgagcggccgacggccttccgcccgctgcgcccgccgccgccgcccggggctgctgcttcctggcctctggctgctgctgctggcccggccggcctcgtgcgccccagatgagctctctccggaacagcacaacctttctttatactccatggagctcgtgctgaagaaaagcactgggcacagcgctgcacaagtggccttaacagaaactgctcccggctcccagcacagcagtcctctccatgtcacagccccgccgtctgccactacttttgatacagccttttttaaccaaggaaaacagaccaaaagtacagcagatcccagcatctttgtggcaacttacgtgtcagtgacgagtaaagaggtggccgtcaatgacgatgagatggataactttctgccagatactcactggaccactccacggatggtttctccaatacagtatatcacagtcagcccaccagggctgcccagggaagcattagaacctatgctcactccatcattacccatggtttctttacaagatgaagaagtgacatcgggctggcagaacacaacgcgacaaccagcggcatatgctgagtccgccagtcatttccacacctttcggtcagcttttcgcacctctgagggcatcgttccaactcctggcaggaatttggtgctttatcctactgatgcttacagtcatttatcaagcaggactctgccagagattgtggcttccctaacagagggtgtggaaaccaccctttttttaagctcccggtctttaatgccacagccgttaggcgacggcattactataccgttgccctccttgggggaggtctcacagcctccagaggaggtttgggccacaagtgcagacagatacactgatgtgaccactgtgttgagtcaaagcctagaagaaaccatctctccaagaacataccccactgtgactgcatcgcacgcagcccttgcattcagcaggacacattctccattgctttcaactcctcttgcatttgcgtcctctgcttcaccaactgatgtttcatctaacccctttctccctagcgactccagcaaaacatccgaattgcatagcaattcagccctccccggtcctgtggacaacactcatatcctgagcccggtgtcctcattcagaccatacacttggtgtgcggcctgcactgtgccttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcccctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatcctcgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactgtgctggccagaagagctgtgcaggagtacatcattacagcaatcaaagaagtactgaggattcacttcaaccgtgcagtggaactgaaggtttacgaactatttactgacttcacttttctggtaacatccggtcctttcgtttacacggcaatatccgtcataaatgtgcttataaacagtaagcttgtccgtgaccagactcctttaatcctgtctgtgaaaccttctttccttgtgccagagtccaggttccaagttcaaacagtacttcagtttgtgcctccgagtgtggatactggcttctgcaacttcacccagcgcattgagaaaggcctaatgacagctctctttgaagtgagaaaacaccaccagggaacgtataacctcacggtgcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcccttccagtatccacagctcaacttatctcagttgctgaagtcctcttgggtcagaacagttctcctgggcgtcatggagaagcaactccagaatgaagtgtttcaagccgagatggaacgcaagctggcccagctgctcagcgaggtttccaccagaaggcggatgtggagaagggccactgtagctgcagggaacagtgtggtgcaggtggtaaatgtgtcgaggctggagggagatgacaatccggtacagctcatctactttgtggaggatcaagatggagaaagactcagtgcagtcaagtcttcggacctgattaacaaaatggacctccagagagcagccatcatcttgggttaccgaattcaaggtgtcattgcccagcctgtcgacagggtgaagaggccgtctccggaatcccagagcaacaacttgtgggtcattgttggcgtggtcatcccagtgctggtggtgatggtgattgttgtcatcctctactggaaactatgccgcacagacaagctagactttcagcctgacactgtggccaacattcagcagcgtcagaagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaagagtttctccctcagatgctgactctacggtcagtgaagagtccagcgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccctcctggacgacgcctttgccctcgtggcccccagcagccagcctgccagcaccgcaggtgtaggccccggagtcccacccggcctgcccgcaaacagcaccccttcccaggaagagaggcgagccacccagtgggggtccttctacagcccagcccagacggccaacaatccctgcagtagatacgaagactatggaatgactcccccgacgggtccattgccaagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccgtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctacattcttcattgtatttgctgtttcttaattgggcacacacaactcctggtcatgtcccagttcagcaccgatcgctaaggccgatcctgtagaatgcggctttcaagaggtcctaactgatcctttcttccactttgctgttgatttgttcacaaattatgtctgaatgagaaatcttctgtaagcagaagttatttaataattcccagcaccacgaaattgttatacatacatccctaccagtcacattccctgtgttcagagcctggaaatgaaattgagttcagttcagcctctctgtaatgaatcaagaaatgtaaaagagctttgagaccccaagggaaaggagagagttgcttctcatttctgattttattgtgctgttactctgtcgagtggctattaaaattgtcttatgctctttgggctaagaggggatcatctcgcttaagatgtactcctgatgtaaacatttcccccactttccaaataatggtaaagaaaacagtggcaagggctgttctgttttctggtacctgagtgaaactcagaagaaaagcaggcttagctaagagattttcactattaacctgtttttattagatcagcgaagacagtcatgcatcgcttaatgatggggatgcattctgagaaatgtgtcattaggctgttttgttgctgtgccaacatcctagattgtacttacacaacctacatggtatagcctactacacacctgggctgtgtggcatggcctattcctcttaggctacaaacctgtacagcatgttactgtactgaacacaatggtaagtatttgtgtatctaaacatagctaaacatagaaaaggtatggtaaaaatacaattttataatcttatgggactaccatcaatatgtagaccgtcattgaccaaaacatcctgatgtgtgcatgactgtacttttcattaaataacagataaggggctatagaatttggggctctgactgatcaaaacctgtgtatctgtgtcaagttttaagacccctgaaacagctaaaacaggtttccaaagtgtaatcactggatttcaaaaccatgttttagcccttcattaatgaagcctgttgtacagatttagagtcttacaatatgagggaagttggttctgggaaggtaagatgtagccagttttcatctgggcacctctgaaagagaaggagtgcaggagagtaagtctctcaaggacgttcaacaaaggaccagcagcatcttatcaggcgatcctcagaggctccaaggagcattggagagaatgcccctttctgggcttgatgtcttggttttggtttaataccaaatttctcttggtcttggtttaatacccgactcctcccaaattgaacgattatctttgtatgtcactcaaaaataccaggtttcctgaatatgttattaagaatttcagatatccaagcagaattttattatggacaccttgtaatgaattcaaatcgtgtgacagcaaacgggataaatggccccttctcacccagttccgctcagggccatacaggcttgcacatagagtgtgctaaaaatggtaacctcctttgagcattgcagaaagagggttctgtttcaaattgggctgaccgtaaaagcaattttgatgtctttcaaactaccataaagggattttaactgtatttttattcttagaaacaatacacctttaaacagatgtcaagaccaaagatgatgtataataaacagccggtggttatggtgtggtgtgagcaggcccccggatcaccagccctctgctggtggtcataaagcacacacagtttgtacttgcttcctctcgacgcctgccacaacagttttgccagtcaccaaactcagaaaaaactagctgtgtgagcagcaccgtaccctagcggtcttcagacattaagttcacgtcatccactgaaaggaagggtccttgcgttgacagcgtgtggctttggagtccgtttatggaagcactctacaatgaacagttgaattttatgtctattcttttttcctattttaaaagttctagtggtaacacaaactgtaaatttgagtcagaatgtttggagaaatgttgtttttttttttttcagagactactttgtcactcactgaccatgtctggttccttctctgaacttcattctccccataagccaaacaagaacagacctcccccgccacctcccaggcaccgtagttgtgagaatcagatgtgatcatgtgtgcagatgtcctgtgaggagggagcataaagcactgtgaaaatgtagcatgctgtctatgtggacgccctaggatgagtgatgtgaaacgctgcactactgcggtgaatgggttcacacatgggtaatgagcaaaaccgaaagctcggtgtgactcagtttcctcactcccattttgctttaatttcacttccttcaccaattttccgattgcatttattaagcatctttctgctcccgactttctggtgtctctggcaccaaataacccagcagacatgagccttgccttctgagattttagaatctaagatagcacgagtgggtatagaagatggaagataccgataaataacatggtttaagtgtcaataaaattcattcgaagagatcaggcgcggtggctcacgcctgtaatcccagcattttgggaggctgaggcaggtggatcacttgagatcaagagcttaaaaccagcccaggcaacatggcaaaaccccgtctctacaaaaaaatacaaaaactagctgggtgtggtggcgcatgcctgtagtcccagctgaggcacgataattgcttgaacccggggggtggaggttgcagtgagctgagattgcaccactgtactccaacctgggcgacagagcaagactgtgtctcaaaaagaaaaaaatttgttcaaaagacataaatgaattaggcacccagaagaagttgcatgtttggaaatgcaatatcttggggagacgtcaacttctgaagtgactttgaaggcagggcagctacccaggcaaatggcgtggaaggaagagctgagagtgggcctgggaaaggctgtagggaaggagtgaagctgtcactgaaatgaacttgatcttgatctgctttgatatggggacagaatccccgactgcactattgagggagtttcagaagagaaggaagaggtgctggaaggatgcttttgcagtcatgcagcaaggaaacgaccagggctgtgaagatctacagaggaagtactccagtgtgggggaggcaagggaagaggacgaaaatgatgagaatgacactgaggtcattgtttagagcagatctcaagcagccgtttggccacgccatatcctttgtggagcatagtgggttatctatctgtctgtctgtctatgtatctgtctatctatctatatatatattcagcttctttactgctacctacacatttttctccaaattttattaatttcatagtgttttgatttgggtggcagatgacttttaagcagtgggtgtttgccggccagatctttcctggcatgcggactgtgaggcaaagcacgggtgaaggtaggcgctaaaggctttgggctaaagccagcacgcggttctgtgctataggagtctcccgtttcccgtggacaggttcagcgttccttctttcgcacaacttttttctaagtgttccagtgaccaagccagtcattcggacactgatttgcagtgcattggcagtaattcacaaattagttgttatataagtctctctcatccctttcacactagattctcagacatgaatgaatttgtcgtttggaaggaaagctgggtaacgttttgggcacaggggaaggaggactccggtcttaactcccacgctaactttagctcaagtggagttttcaccgtggtcatttctacctccggagcaaggtgccagcgccagtactagagcctgcttatccacatttgccctggacaggagcaggaggaagtccacttctgtaccggcagacagagcatgtgaacacaaaacacatttctatggcatagtcaactgaacttcatttttacatttaatctaacatgttaacacgttctaacagggtttctatgagcagctgctgtaacatactcatcaactatgatagacttaacacttgttacctaatgaacaaggaggatgtgcatttcgggtttcttttgatattcgtggaggtgattgtcagtgtttaaacaggactactttctccactatgaagatgacttggaaatcgcaacatcatggtacattgctaagtccatgcttgtgtgtgtgacagtaggcttgataatttatcttaaaacacagcagcattgaaatttaggaaaagaatattaaatgcctttggaaacatgaaacaaagttaggagccagtaagaaagtgacagaagcaatgaatgtcttaatgcagtatagttaaaatggcttcccacagggtagataattatccaggatccttccttttccttcttcctccaggtttttcaggggtcacttcacatttctaaagaaagagtgaataggctgggcatggtggctcaagcctctaatctcaacgctttgggaggctgaggcaggaggatcgcttgaggccaggagtttgagaccaccttgggcaacataacgagaccccgtctctacaaaaaaaatttaaaaattagctgagcatggtggcatgtgccagtagtcccagctactcgaaaggctaagactggaggatcgcttgagccaatgagttggaggctgcagtgagctataatcacgccactgcactccagcctgggctgcagggtgaggtcctgtctctggaaaaaaaaaaaaaaaaaaaaggaataggtaaaagggacagaggtgaaattttgagtgacttgagtctcttgcagtccctgattacacagaacctttctgggctacttggagcatcacgaatagtctttcctgtacttaccagatttcaagtattcataacttgactccctaagtgtacaagttgggaatagtacagggccaagttcaagtcgcatatgctgtactgttcctcctgcaaatgtggggaaagaagagggagatactagaggaactgaggctccacccattcattcagttgctctaagcaccagaggacttgtttcagaaaaggggagtgggaacgccctcgactttgccctcctccggagcatctctgggacgcagggagtctggctagcgttaataggaaaggttgctcggcagagctgccctggagtactgacttgtctctccctcctttgtcaaggtccatgtttttctggctcttcctgcacactcatccctagattatgagcgttaatgtacgaaatgtgcagagcaaattgaggccaactgtggcatcaatactgcaacttaaacttgacaatcatggtttgctggtcctcaaacaggcactgaaatctcagtatgggtatacgatttaataatcggcccctcccttctatttgtcggttttatgtttctatccttcaatagctgcactgttttctaatgtgctgtagagtttttgaaataatttatgcaagtatttggtttccatgtttacaatttatacagctttcctagcattttaaatggaaatgtcaataaatgctatgaattggtgtcaaa

SEQ ID NO: 146010 - DNA, 6283 bp, Homo sapiens
  Payload ID: 8950
  Gene Symbol: KIAA1549
  Gene Name: KIAA1549
  Uniprot ID: Q9HCM3
  ENST ID: ENST00000422774
  CDS Start-End: 50-5902
gacccgagagccgctgagccgcgaggccgggccggggcgccggccgggaatgccgggggcgcggcgccgacgccgaggcgcggccatggaggggaagccccgcgccggggtcgcgctggccccggggccgagcggccgacggccttccgcccgctgcgcccgccgccgccgcccggggctgctgcttcctggcctctggctgctgctgctggcccggccggcctcgtgcgccccagatgagctctctccggaacagcacaacctttctttatactccatggagctcgtgctgaagaaaagcactgggcacagcgctgcacaagtggccttaacagaaactgctcccggctcccagcacagcagtcctctccatgtcacagccccgccgtctgccactacttttgatacagccttttttaaccaaggaaaacagaccaaaagtacagcagatcccagcatctttgtggcaacttacgtgtcagtgacgagtaaagaggtggccgtcaatgacgatgagatggataactttctgccagatactcactggaccactccacggatggtttctccaatacagtatatcacagtcagcccaccagggctgcccagggaagcattagaacctatgctcactccatcattacccatggtttctttacaagatgaagaagtgacatcgggctggcagaacacaacgcgacaaccagcggcatatgctgagtccgccagtcatttccacacctttcggtcagcttttcgcacctctgagggcatcgttccaactcctggcaggaatttggtgctttatcctactgatgcttacagtcatttatcaagcaggactctgccagagattgtggcttccctaacagagggtgtggaaaccaccctttttttaagctcccggtctttaatgccacagccgttaggcgacggcattactataccgttgccctccttgggggaggtctcacagcctccagaggaggtttgggccacaagtgcagacagatacactgatgtgaccactgtgttgagtcaaagcctagaagaaaccatctctccaagaacataccccactgtgactgcatcgcacgcagcccttgcattcagcaggacacattctccattgctttcaactcctcttgcatttgcgtcctctgcttcaccaactgatgtttcatctaacccctttctccctagcgactccagcaaaacatccgaattgcatagcaattcagccctccccggtcctgtggacaacactcatatcctgagcccggtgtcctcattcagaccatacacttggtgtgcggcctgcactgtgccttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcccctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatcctcgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactgtgctggccagaagagctgtgcaggagtacatcattacagcaatcaaagaagtactgaggattcacttcaaccgtgcagtggaactgaaggtttacgaactatttactgacttcacttttctggtaacatccggtcctttcgtttacacggcaatatccgtcataaatgtgcttataaacagtaagcttgtccgtgaccagactcctttaatcctgtctgtgaaaccttctttccttgtgccagagtccaggttccaagttcaaacagtacttcagtttgtgcctccgagtgtggatactggcttctgcaacttcacccagcgcattgagaaaggcctaatgacagctctctttgaagtgagaaaacaccaccagggaacgtataacctcacggtgcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcccttccagtatccacagctcaacttatctcagttgctgaagtcctcttgggtcagaacagttctcctgggcgtcatggagaagcaactccagaatgaagtgtttcaagccgagatggaacgcaagctggcccagctgctcagcgaggtttccaccagaaggcggatgtggagaagggccactgtagctgcagggaacagtgtggtgcaggtggtaaatgtgtcgaggctggagggagatgacaatccggtacagctcatctactttgtggaggatcaagatggagaaagactcagtgcagtcaagtcttcggacctgattaacaaaatggacctccagagagcagccatcatcttgggttaccgaattcaaggtgtcattgcccagcctgtcgacagggtgaagaggccgtctccggaatcccagagcaacaacttgtgggtcattgttggcgtggtcatcccagtgctggtggtgatggtgattgttgtcatcctctactggaaactatgccgcacagacaagctagactttcagcctgacactgtggccaacattcagcagcgtcagaagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaagagtttctccctcagatgctgactctacggtcagtgaagagtccagcgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccctcctggacgacgcctttgccctcgtggcccccagcagccagcctgccagcaccgcaggtgtaggccccggagtcccacccggcctgcccgcaaacagcaccccttcccaggaagagaggcgagccacccagtgggggtccttctacagcccagcccagacggccaacaatccctgcagtagatacgaagactatggaatgactcccccgacgggtccattgccaagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccacacacatgctcggacatcaagagtattcttcttcaccgctatttcaggtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactg

SEQ ID NO: 146011 - DNA, 4492 bp, Homo sapiens
  Payload ID: 8951
  Gene Symbol: KIAA1549L
  Gene Name: KIAA1549-like
  Uniprot ID: Q6ZVL6
  ENST ID: ENST00000265654
  CDS Start-End: 125-3832
tcattccatcatctctgagccagcagagcaatcccccaaagtgctgttagttccccaaacagctccagccgacccctctttaggtcagaacatagctaatcccttaatcccattttctgatgaaatggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacaggtgcagccactaatgcagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcaggtcgcccagtgagaatggctctgtcatcagcaacgaatcagggaagcccagctcagggagacgctcaccccagaatgtaatggcacagcagaaagtgacaaaggaggaggcaaggaagagaaatggtgagaagccttccctccaagaaccacccccagctgctcccacgcgtgcccgcacacacatgcgtgcacacgtgtgcacaaactcacacacagccactgggctctgaccctcagtcgttctttctattctgccccacaagggccaggagtctgtatgtaccccttgggttctcaccttaccccttgtctgaattgtcctgtctcacttcctccgcccctgttcttatgaaatggtgtagttccttaggaaaaaccttttgcggaatgaactgatgtttgcttagaggtttttctaattctctagttagaaatcctctaaaatttctaatttctaatcacatgaattgacgcaatttcttgcaccagttccactaaggcagcagatctctgaaataactgctcatcttggagattcctctcattttcctgccctgactcccctgataagtttcatgggttcagtctgtgccactgagtccagatattgcaactccacttctcccaggaaaaaactaacccaaaacaataaaggaacagatctgtcatc

SEQ ID NO: 146012 - DNA, 11678 bp, Homo sapiens
  Payload ID: 8951
  Gene Symbol: KIAA1549L
  Gene Name: KIAA1549-like
  Uniprot ID: Q6ZVL6
  ENST ID: ENST00000321505
  CDS Start-End: 181-5730
gacattcccccactcctccctctacctccatcctcttcattggctcctgactcacctcattccatcatctctgagccagcagagcaatcccccaaagtgctgttagttccccaaacagctccagccgacccctctttaggtcagaacatagctaatcccttaatcccattttctgatgaaatggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctataaatagacctgattctttgtttccctcgtcaattaaacaaaggccaagaaagagagaagatgagagggaatggtggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgagaatggagcttctctttttcttgggataatagatacatcaacttttacaagaaaatctctgtctcttcaacaatgatgtccagtgtgtgctgctgagtggtacaaaaggaaatagtacttgattcctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtatctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatcaataataatatttcattagtgcaatgatatcaaccagtactttgtctacttggtaaatgcctggaaatactgtatgtgaaaatgatgtttcaagatcttactgtaattgaagtatacgtaaatgtttcagaagacagtgtctgaaatttggctgtttcaatgacttacagagactgagtctacagtttgcagagctatggctccagagtgctaagagggtggagtcacaaatcactgtggtctttacagagccccaggaaatactgagtgagtcaactgagacgactaaaaagatagcatgctaaatcagatactgtcttaaactagacaccatgggttcaagaatagtattaatagatgagaggaaaaccttaagttggaaagaaatcagtctgttcatgttatcccactcatggggagacagagccactctggtcagattttctgtgagtgagatgtggtcccttccctgaagaatctcctaacctcatagaggtgagagagatgactggacagctgactctaagagatggtcaaaagtgcctcaaggaattgaaataaggttcccagagagccctgaggaggcagcaatgaacaaacaccctgttcatcagaaccctctagatagtcacagaagccacaaaaggaccttggttgaccttggaggaggaagcagaagtaccacgaagtggagtgactggcccagtgattcagtcccaacctcctggttcacgaacctgcttgctttccatctcgccatgtggcctgcaggcttgtcagtaacacatttctttagctgtgcctagaggtttaaaaaaaagataagggtcatatgaagaactccataatgttcttgccaagaaaaaagatgattgagtatataacgaacttcagatacagtgtatagaggatgatgcatttgtggcataataaatagttttcagtgctggttttgatatgagttttctgcattcatgaaaaagaaatgcattttggctttttccagaaagagtaccatcaaggaaacggagacctcaactgctgttctagactgtgggggtgcattcctgtctcagcaccaaggatcccaacaggcaggcagggaggcccttgactttgtgtcactgtgaggcagcagagtccatgctctgcatcaggggaggtgcagtaaaggtccattgtgtggcttgagacctatgatctgaggcttgtgcataataagatggcagctgttacctacagagcaaggagtttcctctttcagggtagattatgtaagaatcaattccctggtcccaggagaagttttattgtgagtttgttaatttaagaactcactcagcagaaggacatgtaatgtctgagtaatcttgatggaagaaaggaaatagatctgtgattaaaacacacacacacacacacacacacacacacacacaccctacttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaattcctcttatcacacaccagaaaataatttggattttatttacaaactacatccaaatactcttaaggaaagagtgtcatttagcttggagtagggactgactggggtctaagtgttggaaattaaattctgccattcagtccaacctcaaaggtgttccaggcaaggagttttgcaaggactagaaaccctttcacacttgaagtgcaggtgttggctgaaagaatagagggacatttcacaaacacagaacacggctcccctacaggaaagggatggagacagctacctttgctcttgctctcacattctctgtcctcatggactttcttctctgtttccctctgcctatctatctgcctggttctcttgcttctcctggccaaccagctttctcattagtgcatatgtagctgaaaaatccacccctcaagaacccactccacacaacctttccttttcagtacccaccacgctctgactagcatctctgtgatgcctaaggcaaatttttgaggatctgattggtttagttcatctgcctatgggtgagccaccctggggtcaggtgcctgtccaatcacctgttaccaaggaggcagggccgtgtcatttaagcatggccccatggactgaccctttcagcagggacttttattgggggctggtacccagaagaaggagcatgagtgggcaagaccttcaaaaagaacctactacacactggaactgactagtactcctgggatgccatgccacgcagcagccagcactcggagagcagtcccctggatactaccacacagagaaaaggggcatcttcacttgcacatcaggtgagggtgcacacacttgaaactctgctagactggccagagctgccccagccacttctcaccccaccaccagttattgatacagccgctgggtctaggaagcgatttctgaacaaggcccagttagcacaatgtcttgctcagcagacaataaatacttgtaaattgaattgcatgatcttagctcaggtgctactaatgtggctcacggccacacacttgcatggataagaaaaccaatgagcccctcaacagagtcttttgaaacaaaattggtttcaagtgaaacttacattattttttggctgtgaccttctgaatataataacttagtgtcctgagaattgaaaggcctcttgatttcttaggtgaactgttacagaatcctagcctgtggtaaatgctaaaatgtaaggtgtttctgagaaggaatatttaggaaatataattgtgccacacacacattactttagaagatatgcagttgctctgattctgcaggtttaaaaaaaatgggaagtttgtgatatggcagaatctgtctccattggtcaaaccatacttcagtgagagccattataagtgaaatctaaaaattgatcgttttcattctctgactttggtcagacttttgcaaattatggagagaggccatcaacatattttacataaattactgtggccccatcttatttctcctcatttcttccttatgtttaaacacgcccccatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaa

SEQ ID NO: 146013 - DNA, 2507 bp, Homo sapiens
  Payload ID: 8951
  Gene Symbol: KIAA1549L
  Gene Name: KIAA1549-like
  ENST ID: ENST00000526400
  CDS Start-End: 1-2507
aaccttccaaggattctaccgagtccctggtccaaccggggcctaaagggggacaagaagcagccgatgtgtcagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaa
